US011053316B2

(12) United States Patent
Moore et al.

(10) Patent No.: US 11,053,316 B2
(45) Date of Patent: *Jul. 6, 2021

(54) OPTIMIZED ANTIBODY VARIABLE REGIONS

(71) Applicant: Xencor, Inc., Monrovia, CA (US)

(72) Inventors: Gregory Moore, Arcadia, CA (US); Matthew Bernett, Monrovia, CA (US); Rumana Rashid, Arcadia, CA (US); John Desjarlais, Pasadena, CA (US)

(73) Assignee: Xencor, Inc., Monrovia, CA (US)

( * ) Notice: Subject to any disclaimer, the term of this patent is extended or adjusted under 35 U.S.C. 154(b) by 176 days.

This patent is subject to a terminal disclaimer.

(21) Appl. No.: 16/162,172

(22) Filed: Oct. 16, 2018

(65) Prior Publication Data

US 2019/0270810 A1    Sep. 5, 2019

Related U.S. Application Data

(63) Continuation of application No. 14/207,489, filed on Mar. 12, 2014, now Pat. No. 10,131,710, which is a continuation-in-part of application No. 14/205,227, filed on Mar. 11, 2014, now abandoned, and a continuation-in-part of application No. 14/205,248, filed on Mar. 11, 2014, now Pat. No. 9,650,446, and a continuation-in-part of application No. 14/200,652, filed on Mar. 7, 2014, and a continuation-in-part of application No. 14/200,821, filed on Mar. 7, 2014, now Pat. No. 9,605,084, and a continuation-in-part of application No. 14/155,248, filed on Jan. 14, 2014, now Pat. No. 10,487,155, and a continuation-in-part of application No. 14/155,334, filed on Jan. 14, 2014, now Pat. No. 10,738,132, and a continuation-in-part of application No. 14/155,344, filed on Jan. 14, 2014, now Pat. No. 9,701,759.

(60) Provisional application No. 61/752,348, filed on Jan. 14, 2013, provisional application No. 61/764,954, filed on Feb. 14, 2013, provisional application No. 61/778,157, filed on Mar. 12, 2013, provisional application No. 61/778,148, filed on Mar. 12, 2013, provisional application No. 61/780,334, filed on Mar. 13, 2013, provisional application No. 61/780,310, filed on Mar. 13, 2013, provisional application No. 61/794,695, filed on Mar. 15, 2013, provisional application No. 61/794,896, filed on Mar. 15, 2013, provisional application No. 61/818,401, filed on May 1, 2013, provisional application No. 61/818,153, filed on May 1, 2013, provisional application No. 61/818,344, filed on May 1, 2013, provisional application No. 61/818,410, filed on May 1, 2013, provisional application No. 61/913,870, filed on Dec. 9, 2013, provisional application No. 61/913,879, filed on Dec. 9, 2013, provisional application No. 61/913,832, filed on Dec. 9, 2013, provisional application No. 61/938,095, filed on Feb. 10, 2014.

(51) Int. Cl.
| | | |
|---|---|---|
| C07K 1/18 | (2006.01) | |
| C07K 16/28 | (2006.01) | |
| C07K 16/46 | (2006.01) | |
| C07K 16/00 | (2006.01) | |

(52) U.S. Cl.
CPC ............ *C07K 16/2803* (2013.01); *C07K 1/18* (2013.01); *C07K 16/00* (2013.01); *C07K 16/2809* (2013.01); *C07K 16/468* (2013.01); *C07K 2317/31* (2013.01); *C07K 2317/55* (2013.01); *C07K 2317/565* (2013.01); *C07K 2317/62* (2013.01); *C07K 2317/622* (2013.01); *C07K 2317/64* (2013.01); *C07K 2317/94* (2013.01)

(58) Field of Classification Search
CPC .................................................. C07K 16/2803
USPC ....................................................... 424/136.1
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

U.S. Appl. No. 12/875,015, 2011-0054151, U.S. Pat. No. 9,493,578, filed Sep. 2, 2010, Mar. 3, 2011, Nov. 15, 2016.

(Continued)

*Primary Examiner* — Sean E Aeder
(74) *Attorney, Agent, or Firm* — Louis T. Nguyen; Morgan, Lewis & Bockius, LLP

(57) ABSTRACT

The present invention is directed to optimized anti-CD3 variable sequences for use in a variety of bispecific formats, including those that utilize scFv components. The invention further relates to nucleic acids encoding for the polypeptide, to vectors comprising the same and to host cells comprising the vector. In another aspect, the invention provides for a pharmaceutical composition comprising the mentioned polypeptide and medical uses of the polypeptide.

6 Claims, 181 Drawing Sheets

Specification includes a Sequence Listing.

(56) References Cited

U.S. PATENT DOCUMENTS

| | | |
|---|---|---|
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |

(56) References Cited

U.S. PATENT DOCUMENTS

| | | |
|---|---|---|
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |
| 2018/0118828 A1 | 5/2018 | Bernett et al. |
| 2018/0127501 A1 | 5/2018 | Bernett et al. |
| 2019/0270816 A1 | 9/2019 | Bernett et al. |
| 2019/0382495 A1 | 12/2019 | Bernett et al. |
| 2019/0389954 A1 | 12/2019 | Bernett et al. |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |

(56) References Cited

FOREIGN PATENT DOCUMENTS

| | | |
|---|---|---|
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016182751 | 11/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2018041838 | 3/2018 |
| WO | WO2019050521 | 3/2019 |

OTHER PUBLICATIONS

U.S. Appl. No. 15/279,266, 2017-0058053, filed Sep. 28, 2016, Mar. 2, 2017.

U.S. Appl. No. 16/539,986, 2020-0123274, filed Aug. 13, 2019, Apr. 23, 2020.

U.S. Appl. No. 14/084,515, 2014-0161790, filed Nov. 19, 2013, Jun. 12, 2014.

U.S. Appl. No. 13/009,820, 2011-0236375, U.S. Pat. No. 8,362,210, filed Jan. 19, 2011, Sep. 29, 2011, Jan. 29, 2013.

U.S. Appl. No. 13/747,317, 2013-0122001, U.S. Pat. No. 9,475,881, filed Jan. 22, 2013, May 16, 2013, Oct. 25, 2016.

U.S. Appl. No. 15/264,495, filed Sep. 13, 2016.

U.S. Appl. No. 13/648,951, 2013-0171095, filed Oct. 10, 2012, Jul. 4, 2013.

U.S. Appl. No. 13/032,491, 2011-0287032, U.S. Pat. No. 8,329,867, filed Feb. 22, 2011, Nov. 24, 2011, Dec. 11, 2012.

U.S. Appl. No. 13/710,305, 2013-0089550, U.S. Pat. No. 8,629,113, filed Dec. 10, 2012, Apr. 11, 2013, Jan. 14, 2014.

U.S. Appl. No. 14/142,705, 2014-0112924, U.S. Pat. No. 9,371,397, filed Dec. 27, 2013, Apr. 24, 2014, Jun. 21, 2016.

U.S. Appl. No. 15/159,667, 2016-0264643, U.S. Pat. No. 10,155,800, filed May 19, 2016, Sep. 15, 2016, Dec. 18, 2018.

U.S. Appl. No. 16/189,917, 2019-0127437, filed Nov. 13, 2018, May 2, 2019.

U.S. Appl. No. 13/194,904, 2012-0028304, U.S. Pat. No. 8,637,641, filed Jul. 29, 2011, Feb. 2, 2012, Jan. 28, 2014.

U.S. Appl. No. 14/165,487, 2014-0249297, U.S. Pat. No. 9,605,061, filed Jan. 27, 2014, Sep. 4, 2014, Mar. 28, 2017.

U.S. Appl. No. 15/444,087, 2017-0174757, filed Feb. 27, 2017, Jun. 22, 2017.

U.S. Appl. No. 13/568,028, filed Aug. 6, 2012.

U.S. Appl. No. 14/853,622, 2016-0068588, filed Sep. 14, 2015, Mar. 10, 2016.

U.S. Appl. No. 13/887,234, filed May 3, 2013.

U.S. Appl. No. 14/156,431, 2014-0212435, filed Jan. 15, 2014, Jul. 31, 2014.

U.S. Appl. No. 14/156,432, 2014-0212436, U.S. Pat. No. 9,738,722, filed Jan. 15, 2014, Jul. 31, 2014, Aug. 22, 2017.

(56) References Cited

OTHER PUBLICATIONS

U.S. Appl. No. 14/808,826, 2016-0060360, filed Jul. 24, 2015, Mar. 3, 2016.
U.S. Appl. No. 15/682,380, 2018-0201686, filed Aug. 21, 2017, Jul. 19, 2018.
U.S. Appl. No. 14/155,248, 2014-0322217, U.S. Pat. No. 10,487,155, filed Jan. 14, 2014, Oct. 30, 2014, Nov. 26, 2019.
U.S. Appl. No. 14/155,334, 2014-0370013, filed Jan. 14, 2014, Dec. 18, 2014.
U.S. Appl. No. 14/155,344, 2014-0294833, U.S. Pat. No. 9,701,759, filed Jan. 14, 2014, Oct. 2, 2014, Jul. 11, 2017.
U.S. Appl. No. 14/205,227, 2014-0294835, filed Mar. 11, 2014, Oct. 2, 2014.
U.S. Appl. No. 14/205,248, 2014-0288275, U.S. Pat. No. 9,650,446, filed Mar. 11, 2014, Sep. 25, 2014, May 16, 2017.
U.S. Appl. No. 15/589,908, 2018-0142040, filed May 8, 2017, May 24, 2018.
U.S. Appl. No. 15/633,629, 2018-0215834, U.S. Pat. No. 10,472,427, filed Jun. 26, 2017, Aug. 2, 2018, Nov. 12, 2019.
U.S. Appl. No. 16/584,317, filed Sep. 26, 2019.
U.S. Appl. No. 16/918,922, filed Jul. 1, 2020.
U.S. Appl. No. 14/214,418, 2014-0356381, U.S. Pat. No. 10,106,624, filed Mar. 14, 2014, Dec. 4, 2014, Oct. 23, 2018.
U.S. Appl. No. 16/137,389, filed Sep. 20, 2018.
U.S. Appl. No. 14/214,475, 2014-0294836, U.S. Pat. No. 10,519,242, filed Mar. 14, 2014, Oct. 2, 2014, Dec. 31, 2019.
U.S. Appl. No. 14/217,166, 2014-0294759, U.S. Pat. No. 10,544,187, filed Mar. 17, 2014, Oct. 2, 2014, Jan. 28, 2020.
U.S. Appl. No. 16/721,356, filed Dec. 19, 2019.
U.S. Appl. No. 14/200,652, 2014-0302064, filed Mar. 7, 2014, Oct. 9, 2014.
U.S. Appl. No. 14/207,489, 2014-0377270, U.S. Pat. No. 10,131,710, filed Mar. 12, 2014, Dec. 25, 2014, Nov. 20, 2018.
U.S. Appl. No. 16/162,172, 2019-0270810, filed Oct. 16, 2018, Sep. 5, 2019.
U.S. Appl. No. 14/210,236, 2015-0071948, filed Mar. 13, 2014, Mar. 12, 2015.
U.S. Appl. No. 15/406,588, 2017-0166655, filed Jan. 13, 2017, Jun. 15, 2017.
U.S. Appl. No. 15/624,531, filed Jun. 15, 2017.
U.S. Appl. No. 15/883,006, 2018-0360981, filed Jan. 29, 2018, Dec. 20, 2018.
U.S. Appl. No. 14/200,821, 2014-0294823, U.S. Pat. No. 9,605,084, filed Mar. 7, 2014, Oct. 2, 2014, Mar. 28, 2017.
U.S. Appl. No. 14/216,705, 2014-0363426, filed Mar. 17, 2014, Dec. 11, 2014.
U.S. Appl. No. 15/444,026, 2018-0037668, U.S. Pat. No. 10,287,364, filed Feb. 27, 2017, Feb. 8, 2018, May 14, 2019.
U.S. Appl. No. 16/364,093, 2020-0048370, filed Mar. 25, 2019, Feb. 13, 2020.
U.S. Appl. No. 14/673,695, 2015-0307629, filed Mar. 30, 2015, Oct. 29, 2015.
U.S. Appl. No. 15/786,252, 2018-0094079, filed Oct. 17, 2017, Apr. 5, 2018.
U.S. Appl. No. 14/952,705, 2016-0176969, filed Nov. 25, 2015, Jun. 23, 2016.
U.S. Appl. No. 14/952,714, 2016-0229924, filed Nov. 25, 2015, Aug. 11, 2016.
U.S. Appl. No. 15/141,350, 2016-0355608, U.S. Pat. No. 10,259,887, filed Apr. 28, 2016, Dec. 8, 2016, Apr. 16, 2019.
U.S. Appl. No. 15/945,679, 2018-0282432, filed Apr. 4, 2018, Oct. 4, 2018.
U.S. Appl. No. 15/945,681, 2018-0223000, filed Apr. 4, 2018, Aug. 9, 2018.
U.S. Appl. No. 16/354,058, 2019-0202938, filed Mar. 14, 2019, Jul. 4, 2019.
U.S. Appl. No. 14/952,786, 2016-0215063, filed Nov. 25, 2015, Jul. 28, 2016.
U.S. Appl. No. 15/779,325, filed May 25, 2018.
U.S. Appl. No. 14/757,809, 2016-0355600, U.S. Pat. No. 10,428,155, filed Dec. 22, 2015, Dec. 8, 2016, Oct. 1, 2019.
U.S. Appl. No. 16/530,946, 2019-0352416, filed Aug. 2, 2019, Nov. 21, 2019.
U.S. Appl. No. 15/063,441, 2017-0037131, U.S. Pat. No. 10,227,411, filed Mar. 7, 2016, Feb. 9, 2017, Mar. 12, 2019.
U.S. Appl. No. 16/297,255, 2019-0194325, filed Mar. 8, 2019, Jun. 27, 2019.
U.S. Appl. No. 15/372,360, 2017-0320947, U.S. Pat. No. 10,227,410, filed Dec. 7, 2016, Nov. 9, 2017, Mar. 12, 2019.
U.S. Appl. No. 16/489,539, filed Aug. 28, 2019.
U.S. Appl. No. 15/623,314, 2018-0118836, filed Jun. 14, 2017, May 3, 2018.
U.S. Appl. No. 16/435,373, 2019-0382495, filed Jun. 7, 2019, Dec. 19, 2019.
U.S. Appl. No. 16/435,375, 2019-0389954, filed Jun. 7, 2019, Dec. 26, 2019.
U.S. Appl. No. 15/611,361, 2017-0349660, filed Jun. 1, 2017, Dec. 7, 2017.
U.S. Appl. No. 15/611,683, 2017-0349657, filed Jun. 1, 2017, Dec. 7, 2017.
U.S. Appl. No. 15/636,590, 2018-0118827, U.S. Pat. No. 10,316,088, filed Jun. 28, 2017, May 3, 2018, Jun. 11, 2019.
U.S. Appl. No. 16/393,900, 2019-0248898, filed Apr. 24, 2019, Aug. 15, 2019.
U.S. Appl. No. 15/185,958, 2017-0081420, U.S. Pat. No. 9,850,320, filed Jun. 17, 2016, Mar. 23, 2017, Dec. 26, 2017.
U.S. Appl. No. 15/186,167, 2017-0081424, U.S. Pat. No. 9,856,327, filed Jun. 17, 2016, Mar. 23, 2017, Jan. 2, 2018.
U.S. Appl. No. 15/691,665, 2018-0127501, filed Aug. 30, 2017, May 10, 2018.
U.S. Appl. No. 16/820,375, filed Mar. 16, 2020.
U.S. Appl. No. 15/785,401, 2018-0118805, U.S. Pat. No. 10,501,543, filed Oct. 16, 2017, May 3, 2018, Dec. 10, 2019.
U.S. Appl. No. 16/660,028, 2020-0040083, filed Oct. 22, 2019, Feb. 6, 2020.
U.S. Appl. No. 15/785,393, 2018-0118828, U.S. Pat. No. 10,550,185, filed Oct. 16, 2017, May 3, 2018, Feb. 4, 2020.
U.S. Appl. No. 16/718,072, 2020-0123259, filed Dec. 17, 2019, Apr. 23, 2020.
U.S. Appl. No. 16/388,174, 2019-0365861, filed Apr. 18, 2019, Dec. 5, 2019.
U.S. Appl. No. 16/388,811, 2019-0389933, filed Apr. 18, 2019, Dec. 26, 2019.
U.S. Appl. No. 16/600,236, 2020-0140512, filed Oct. 11, 2019, May 7, 2020.
U.S. Appl. No. 15/525,007, 2017-0335007, U.S. Pat. No. 10,556,959, filed May 5, 2017, Nov. 23, 2017, Feb. 11, 2020.
U.S. Appl. No. 16/607,241, filed Oct. 22, 2019.
U.S. Appl. No. 16/025,963, 2019-0016778, filed Jul. 2, 2018, Jan. 17, 2019.
U.S. Appl. No. 16/184,895, 2019-0263909, filed Nov. 8, 2018, Aug 29, 2019.
U.S. Appl. No. 16/184,929, 2019-0270816, filed Nov. 8, 2018, Sep. 5, 2019.
U.S. Appl. No. 16/206,849, 2019-0241638, filed Nov. 30, 2018, Aug. 8, 2019.
U.S. Appl. No. 16/375,777, 2020-0165356, Apr. 4, 2019, May 28, 2020.
U.S. Appl. No. 16/388,646, 2019-0352362, filed Apr. 18, 2019, Nov. 21, 2019.
U.S. Appl. No. 16/388,729, 2019-0359684, filed Apr. 18, 2019, Nov. 28, 2019.
U.S. Appl. No. 16/592,656, filed Oct. 3, 2019.
U.S. Appl. No. 16/798,247, filed Feb. 21, 2020.
U.S. Appl. No. 16/832,440, filed Mar. 27, 2020.
U.S. Appl. No. 16/724,118, filed Dec. 20, 2019.
U.S. Appl. No. 16/875,878, filed May 15, 2020.
U.S. Appl. No. 16/805,453, filed Feb. 28, 2020.
U.S. Appl. No. 14/210,363, 2014-0294812, filed Mar. 13, 2014, Oct. 2, 2014.
U.S. Appl. No. 15/811,315, 2018-0222965, filed Nov. 13, 2017, Aug. 9, 2018.

(56) References Cited

OTHER PUBLICATIONS

U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann, et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.

(56) References Cited

OTHER PUBLICATIONS

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Immunotherapy with Long-Lived Anti-CD123 x Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.
Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins by T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Non neutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers is Mediated by a CH2-CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.

(56) References Cited

OTHER PUBLICATIONS

Fraker et al., Crystal structure of peptide cyclo-(D-VAL-L-PRO-L-VAL-D-PRO)$_3$, 4978, Biochem. Biophys. Res. Commun. 80(4):849-57.
Francois, et al., Construction of a Bispecific Antibody Reacting with the 60- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Cheminstry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$- Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD2O-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.

(56) References Cited

OTHER PUBLICATIONS

Kabat et al., 1991, Sequences of proteins of immunological interest, Department of Health and Human Services, Bethesda, vol. 1, 5$^{th}$ Ed.

Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

Kettleborough et al., Humanization of a mouse monoclonal antibody by CDR-grafting: the importance of framework residues on loop conformation, 1991, Protein Eng. 4(7):773-83.

Keyna, et al., Surrogate Light Chain-Dependent Selection of Ig Heavy Chain V Regions, J. Immunol., 1995, vol. 155, pp. 5536-5542.

Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.

Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.

Kim et al., "Localization of the site of murine IgG1 molecule that is involved in binding the murine intestinal Fc receptor," Eur. J. Immunol., 24:2429-2434, 1994.

Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.

Kipriyanov, et al., Bispecific CD3 x CD19 Diabody for T Cell-Mediated Lysis of Malignant Human B Cells, Int. J. Cancer, 1998. vol. 77, pp. 763-772.

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klein et al., Progression of metastatic human prostate cancer to androgen independence in immunodeficient SDIC mice, 1997, Nature Medicine 3: 402-408.

Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.

Klinger, et al., Immunopharmacologic response of patients with B-lineage acute lymphoblastic leukemia to continuous infusion of T cell—engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992, vol. 148, pp. 1547-1553.

Krah et al., "Single-domain antibodies for biomedical applications.", Immunopharmacol Immunotoxicol. 2016;38(1):21-8. doi: 10.3109/08923973.2015.1102934. Epub Nov. 9, 2015.

Krauss et al., Specificity grafting of human antibody frameworks selected from a phage display library: generation of a highly stable humanized anti-CD22 single-chain Fv fragment, 2003, Protein Engineering 16(10):753-759.

Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No. 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins o'$_1$ effectively suppress growth and dissemination of liver metastases in a syngeneic model of murine neuroblastoma, 1998, Cancer Res. 58:2928.

Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

(56) References Cited

OTHER PUBLICATIONS

Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.Immunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.
MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-80 B Cells are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al, Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink 2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44 , pp. 1935-1943.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., Beat® the bispecific challenge: a novel and efficient platform for the expression of bispecific IgGs. BMC Proceedings 2013 7(Suppl 6):O9.

(56) References Cited

OTHER PUBLICATIONS

Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (-)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington'S Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering, 1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.

(56) References Cited

OTHER PUBLICATIONS

Röthlisberger, et al., Domain Interactions in the Fab Fragment: A Comparative Evaluation of the Single-chain Fv and Fab Format Engineered with Variable Domains of Different Stability, J. Mol. Biol., 2005, vol. 347, pp. 773-789.

Salmeron et al., A conformational epitope expressed upon association of CD3-epsilon with either CD3-delta or CD3-gamma is the main target for recognition by anti-CD3 monoclonal antibodies, Nov. 1, 1991.

Sancho et al., CD3—Surface Expression is Required for CD4-p56ick-mediated Up-regulation of T Cell Antigen Receptor-CD3 Signaling in T Cells, Apr. 16, 1992.

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.

Schaefer, et al., Immunoglobulin domain crossover as a generic approach for the production of bispecific IgG antibodies, PNAS, 2011, vol. 108, No. 27, pp. 11187-11192.

Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.

Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.

Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.

Schroder et al., The Peptides, vol. pp. 76-136,1965, Academic Press.

Senter et al, Proceedings of the American Association for Cancer Research, 2004, vol. 45, Abstract No. 623.

Senter, Potent antibody drug conjugates for cancer therapy, 2009, Current Opin. Chem. Biol. 13:235.

Sforzini et al., Targeting of saporin to Hodgkin's lymphoma cells by anti-CD30 and anti-CD25 bispecific antibodies., Br J Haematol. Sep. 1998;102(4):1061-8.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/β T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human FcγRIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.

Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-19258.

Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

(56) References Cited

OTHER PUBLICATIONS

Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble $\alpha\beta$ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fc$\gamma$ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.
Wigginton et al., An immunoglobulin E-reactive chimeric human immunoglobulin G1 anti-idiotype inhibits basophil degranulation through cross-linking of Fc$\epsilon$RI with Fc$\gamma$RIIb., Clinical & Experimental Allergy, 38: 313-319.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-1$\alpha$/$\beta$ dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.

(56) References Cited

OTHER PUBLICATIONS

Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Intery Aging. 2009;4:197-205. Epub May 14, 2009.
Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.
Zhang et al., The development of bispecific antibodies and their applications in tumor immune escape., Experimental Hematology & Oncology 2017 6:12.
Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.
Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.
Masarova et al., Immune Checkpoint Approaches in AML and MDS: A Next Frontier?, The Journal of Targeted Therapies in Cancer, Mar. 6, 2017 (Mar. 6, 2017), XP002784099.
Scott et al., Antibody therapy of cancer., Nat Rev Cancer. Mar. 22, 2012;12(4):278-87. doi: 10.1038/nrc3236.

Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.
Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.
Fos et al., ICOS ligation recruits the p50alpha PI3K regulatory subunit to the immunological synapse., J Immunol. Aug. 1, 2008;181(3):1969-77.
Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004;34(5):1282-90.
Madrenas et al., Conversion of CTLA-4 from inhibitor to activator of T cells with a bispecific tandem single-chain Fv ligand., J Immunol. May 15, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09. 006.
Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.
Shields et al; "High Resolution Mapping of the Binding Site on Human IgG 1 for FcγRI, FcγRII, FcγRIII, and FcRn and Design of IgG1 Variants with Improved Binding to the FcγR*", The Journal of Biological Chemistry, 2001, 276(2):6591-6604.
Szymkowski et al; "Anti-CD38-anti-CD3 bispecific antibody in multiple myeloma", Xencor, pp. 1-15.

Figure 1A

| XENP | VH ID | VL ID | VH Substitutions | VL Substitutions |
|---|---|---|---|---|
| 11502 | H1 | L1.4 | | |
| 11794 | H1.3 | L1.4 | L11D | |
| 11795 | H1.4 | L1.4 | L11K | |
| 11796 | H1.5 | L1.4 | L11N | |
| 11801 | H1.6 | L1.4 | L11S | |
| 11802 | H1.7 | L1.4 | R19K | |
| 11803 | H1.8 | L1.4 | N30S | |
| 11804 | H1.9 | L1.4 | N35H | |
| 11805 | H1.10 | L1.4 | N35S | |
| 11806 | H1.11 | L1.4 | P41S | |
| 11807 | H1.12 | L1.4 | Y52CA | |
| 11808 | H1.13 | L1.4 | Y52CA/N54S | |
| 11809 | H1.14 | L1.4 | Y58A | |
| 11810 | H1.15 | L1.4 | D61A | |
| 11811 | H1.16 | L1.4 | D73N | |
| 11812 | H1.17 | L1.4 | D73T | |
| 11813 | H1.18 | L1.4 | L78A | |
| 11814 | H1.19 | L1.4 | A84D | |
| 11815 | H1.20 | L1.4 | A84K | |
| 11816 | H1.21 | L1.4 | A84S | |
| 11817 | H1.22 | L1.4 | V93A | |
| 11818 | H1.23 | L1.4 | V93T | |
| 11819 | H1.24 | L1.4 | N100D | |
| 11820 | H1.25 | L1.4 | N100Q | |
| 11821 | H1.26 | L1.4 | S100AT | |
| 11822 | H1.27 | L1.4 | A101D | |
| 11823 | H1.28 | L1.4 | L108T | |
| 11824 | H1.29 | L1.30 | G44S | G100S |
| 11825 | H1 | L1.10 | | E7P |
| 11826 | H1 | L1.11 | | T12S |
| 11827 | H1 | L1.12 | | G17A |
| 11828 | H1 | L1.13 | | G17Q |
| 11829 | H1 | L1.14 | | T29S |
| 11830 | H1 | L1.15 | | T29S/S30G/N31H |
| 11831 | H1 | L1.16 | | G49Y/G50D |
| 11832 | H1 | L1.17 | | K53N |
| 11833 | H1 | L1.18 | | P56S |
| 11834 | H1 | L1.19 | | N52S/K53N/R54K/A55H/P56S/G57W/V58T |
| 11835 | H1 | L1.20 | | A60D |
| 11836 | H1 | L1.21 | | L66K/L67S |
| 11837 | H1 | L1.22 | | L66S/L67S |

Figure 1B

| | | | | |
|---|---|---|---|---|
| 11838 | H1 | L1.23 | | L75I |
| 11839 | H1 | L1.24 | | P80A |
| 11840 | H1 | L1.25 | | P80S |
| 11841 | H1 | L1.26 | | E85D |
| 11842 | H1 | L1.27 | | A89L |
| 11843 | H1 | L1.28 | | L95H |
| 11844 | H1 | L1.29 | | T105E/V106I/L106AK |
| 11920 | H1 | L3.1 | | |
| 11921 | H1 | L5.1 | | |
| 11922 | H1 | L1.31 | | L75D/E85D/L95H |
| 11923 | H1 | L1.32 | | Q38E |
| 12107 | H1.38 | L1.4 | V89T | |
| 12108 | H1 | L1.33 | | Q42K |
| 12109 | H1 | L1.34 | | Q42T |
| 12110 | H1 | L1.35 | | Q42S/A43P |
| 12111 | H1 | L1.36 | | A43P |
| 12112 | H1 | L1.37 | | A43G |
| 12113 | H1 | L1.38 | | A43S |
| 12114 | H1 | L1.39 | | A43D |
| 12131 | H1.30 | L1.4 | N30S/N100D | |
| 12132 | H1.31 | L1.4 | N30S/N35S/N100D | |
| 12133 | H1.32 | L1.4 | N30S/Y52CA/N100D | |
| 12134 | H1.33 | L1.4 | N30S/N100D/A101D | |
| 12135 | H1.34 | L1.4 | N30S/N35S/Y52CA/N100D/A101D | |
| 12136 | H1.35 | L1.4 | G10E/L11V/V12K/Q13K/G16E | |
| 12137 | H1.36 | L1.4 | K52BN/Y52C_/N53_/N54G/Y55G/A56S | |
| 12138 | H1.37 | L1.4 | Q39K | |
| 12139 | H1.37 | L1.32 | Q39K | Q38E |
| 12149 | H1 | L1.40 | | L75I/E85D/L95H |
| 12213 | H1.30 | L1.40 | N30S/N100D | L75I/E85D/L95H |
| 12214 | H1.8 | L1.40 | N30S | L75I/E85D/L95H |
| 12215 | H1.39 | L1.40 | N30S/Q39K | L75I/E85D/L95H |
| 12216 | H1.40 | L1.40 | N30S/Q39K/N100D | L75I/E85D/L95H |
| 12217 | H1.30 | L1.41 | N30S/N100D | L75I/L95H |
| 12218 | H1.8 | L1.41 | N30S | L75I/L95H |
| 12219 | H1.39 | L1.41 | N30S/Q39K | L75I/L95H |
| 12220 | H1.40 | L1.41 | N30S/Q39K/N100D | L75I/L95H |
| 12221 | H1.30 | L1.42 | N30S/N100D | L75I/Q42K/L95H |

Figure 1C

| | | | | |
|---|---|---|---|---|
| 12222 | H1.8 | L1.42 | N30S | L75I/Q42K/L95H |
| 12223 | H1.39 | L1.42 | N30S/Q39K | L75I/Q42K/L95H |
| 12224 | H1.40 | L1.42 | N30S/Q39K/N100D | L75I/Q42K/L95H |
| 12225 | H1.30 | L1.43 | N30S/N100D | L75I/A43S/L95H |
| 12226 | H1.8 | L1.43 | N30S | L75I/A43S/L95H |
| 12227 | H1.39 | L1.43 | N30S/Q39K | L75I/A43S/L95H |
| 12228 | H1.40 | L1.43 | N30S/Q39K/N100D | L75I/A43S/L95H |
| 12229 | H1.30 | L1.44 | N30S/N100D | L75I/Q42K/A43S/L95H |
| 12230 | H1.8 | L1.44 | N30S | L75I/Q42K/A43S/L95H |
| 12231 | H1.39 | L1.44 | N30S/Q39K | L75I/Q42K/A43S/L95H |
| 12232 | H1.40 | L1.44 | N30S/Q39K/N100D | L75I/Q42K/A43S/L95H |
| 12233 | H1.30 | L1.45 | N30S/N100D | L75I/Q42K/E85D/L95H |
| 12234 | H1.8 | L1.45 | N30S | L75I/Q42K/E85D/L95H |
| 12235 | H1.39 | L1.45 | N30S/Q39K | L75I/Q42K/E85D/L95H |
| 12236 | H1.40 | L1.45 | N30S/Q39K/N100D | L75I/Q42K/E85D/L95H |
| 12237 | H1.30 | L1.46 | N30S/N100D | L75I/A43S/E85D/L95H |
| 12238 | H1.8 | L1.46 | N30S | L75I/A43S/E85D/L95H |
| 12239 | H1.39 | L1.46 | N30S/Q39K | L75I/A43S/E85D/L95H |
| 12240 | H1.40 | L1.46 | N30S/Q39K/N100D | L75I/A43S/E85D/L95H |
| 12241 | H1.30 | L1.47 | N30S/N100D | L75I/Q42K/A43S/E85D/L95H |
| 12242 | H1.8 | L1.47 | N30S | L75I/Q42K/A43S/E85D/L95H |
| 12243 | H1.39 | L1.47 | N30S/Q39K | L75I/Q42K/A43S/E85D/L95H |
| 12244 | H1.40 | L1.47 | N30S/Q39K/N100D | L75I/Q42K/A43S/E85D/L95H |

Figure 2A

Humanized anti-CD3 heavy chain variable region
SEQ ID NO. 1.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS Humanized anti-CD3 light chain variable region
SEQ ID NO. 2.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11502 H1_L1.4

SEQ ID NO. 3.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 4.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 5.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 6.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11794 H1.3_L1.4

SEQ ID NO. 7.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 8.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2B

SEQ ID NO. 9.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 10.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11795 H1.4_L1.4

SEQ ID NO. 11.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 12.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 13.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 14.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11796 H1.5_L1.4
SEQ ID NO. 15.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

XENP11796 H1.5_L1.4, cont.
SEQ ID NO. 16.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 17.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

Figure 2C

SEQ ID NO. 18.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11801 H1.6_L1.4

SEQ ID NO. 19.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 20.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 21.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 22.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11802 H1.7_L1.4

SEQ ID NO. 23.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 24.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 25.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 26.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2D

XENP11803 H1.8_L1.4

SEQ ID NO. 27.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 28.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 29.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 30.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11804 H1.9_L1.4

SEQ ID NO. 31.
EVQLVESGGGLVQPGGSLRLSCAASGFTFNTYAMHWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 32.
EVQLVESGGGLVQPGGSLRLSCAASGFTFNTYAMHWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 33.
EVQLVESGGGLVQPGGSLRLSCAASGFTFNTYAMHWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 34.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2E

XENP11805 H1.10_L1.4

SEQ ID NO. 35.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 36.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 37.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 38.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11806 H1.11_L1.4

SEQ ID NO. 39.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 40.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 41.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 42.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2F

XENP11807 H1.12_L1.4

SEQ ID NO. 43.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 44.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 45.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSS

SEQ ID NO. 46.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11808 H1.13_L1.4

SEQ ID NO. 47.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 48.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 49.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSS

SEQ ID NO. 50.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2G

XENP11809 H1.14_L1.4

SEQ ID NO. 51.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 52.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 53.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSS

SEQ ID NO. 54.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11810 H1.15_L1.4

SEQ ID NO. 55.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 56.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 57.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSS

SEQ ID NO. 58.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2H

XENP11811 H1.16_L1.4

SEQ ID NO. 59.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 60.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 61.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSS

SEQ ID NO. 62.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11812 H1.17_L1.4

SEQ ID NO. 63.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 64.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 65.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTV

SEQ ID NO. 66.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2I

XENP11813 H1.18_L1.4

SEQ ID NO. 67.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 68.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 69.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSS

SEQ ID NO. 70.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11814 H1.19_L1.4

SEQ ID NO. 71.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 72.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 73.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSS

SEQ ID NO. 74.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2J

XENP11815 H1.20_L1.4

SEQ ID NO. 75.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 76.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 77.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSS

SEQ ID NO. 78.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11816 H1.21_L1.4

SEQ ID NO. 79.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 80.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 81.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSS

SEQ ID NO. 82.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2K

XENP11817 H1.22_L1.4

SEQ ID NO. 83.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 84.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 85.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSS

SEQ ID NO. 86.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11818 H1.23_L1.4

SEQ ID NO. 87.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 88.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 89.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSS

SEQ ID NO. 90.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2L

XENP11819 H1.24_L1.4

SEQ ID NO. 91.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 92.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 93.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 94.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11820 H1.25_L1.4

SEQ ID NO. 95.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 96.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 97.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSS

SEQ ID NO. 98.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2M

XENP11821 H1.26_L1.4

SEQ ID NO. 99.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 100.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 101.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSS

SEQ ID NO. 102.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11822 H1.27_L1.4

SEQ ID NO. 103.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 104.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 105.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSS

SEQ ID NO. 106.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2N

XENP11823 H1.28_L1.4

SEQ ID NO. 107.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 108.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 109.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSS

SEQ ID NO. 110.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11824 H1.29_L1.30

SEQ ID NO. 111.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 112.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 113.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 114.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 20

XENP11825 H1_L1.10

SEQ ID NO. 115.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 116.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 117.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 118.
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11826 H1_L1.11

SEQ ID NO. 119.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 120.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 121.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 122.
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2P

XENP11827 H1_L1.12

SEQ ID NO. 123.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 124.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 125.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 126.
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11828 H1_L1.13

SEQ ID NO. 127.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 128.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 129.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 130.
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2Q

XENP11829 H1_L1.14

SEQ ID NO. 131.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 132.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVL

SEQ ID NO. 133.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 134.
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVL

XENP11830 H1_L1.15

SEQ ID NO. 135.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 136.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVL

SEQ ID NO. 137.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 138.
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVL

Figure 2R

XENP11831 H1_L1.16

SEQ ID NO. 139.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVLGSHHHHHH

SEQ ID NO. 140.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVL

SEQ ID NO. 141.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 142.
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVL

XENP11832 H1_L1.17

SEQ ID NO. 143.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVLGSHHHHHH

SEQ ID NO. 144.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVL

SEQ ID NO. 145.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 146.
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVL

Figure 2S

XENP11833 H1_L1.19

SEQ ID NO. 147.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVLGSHHHHHH

SEQ ID NO. 148.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVL

SEQ ID NO. 149.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 150.
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVL

XENP11834 H1_L1.19

SEQ ID NO. 151.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVLGSHHHHHH

SEQ ID NO. 152.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVL

SEQ ID NO. 153.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 154.
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVL

Figure 2T

XENP11835 H1_L1.20

SEQ ID NO. 155.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVLGSHHHHHH

SEQ ID NO. 156.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVL

SEQ ID NO. 157.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 158.
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVL

XENP11836 H1_L1.21

SEQ ID NO. 159.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVLGSHHHHHH

SEQ ID NO. 160.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVL

SEQ ID NO. 161.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 162.
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVL

Figure 2U

XENP11837 H1_L1.22

SEQ ID NO. 163.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVLGSHHHHHH

SEQ ID NO. 164.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVL

SEQ ID NO. 165.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 166.
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVL

XENP11838 H1_L1.23

SEQ ID NO. 167.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVLGSHHHHHH

SEQ ID NO. 168.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVL

SEQ ID NO. 169.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 170.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVL

Figure 2V

XENP11839 H1_L1.24

SEQ ID NO. 171.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVLGSHHHHHH

SEQ ID NO. 172.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVL

SEQ ID NO. 173.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 174.
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVL

XENP11840 H1_L1.25

SEQ ID NO. 175.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVLGSHHHHHH

SEQ ID NO. 176.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVL

SEQ ID NO. 177.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 178.
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVL

Figure 2W

XENP11841 H1_L1.26

SEQ ID NO. 179.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVLGSHHHHHH

SEQ ID NO. 180.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVL

SEQ ID NO. 181.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 182.
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVL

XENP11842 H1_L1.27

SEQ ID NO. 183.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVLGSHHHHHH

SEQ ID NO. 184.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVL

SEQ ID NO. 185.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 186.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVL

Figure 2X

XENP11843 H1_L1.28

SEQ ID NO. 187.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVLGSHHHHHH

SEQ ID NO. 188.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVL

SEQ ID NO. 189.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 190.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVL

XENP11844 H1_L1.29

SEQ ID NO. 191.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGSHHHHHH

SEQ ID NO. 192.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGS

SEQ ID NO. 193.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 194.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGS

Figure 2Y

XENP11920 H1_L3.1

SEQ ID NO. 195.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGSHHHHHH

SEQ ID NO. 196.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGS

SEQ ID NO. 197.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 198.
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGS

XENP11921 H1_L5.1

SEQ ID NO. 199.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGSHHHHHH

SEQ ID NO. 200.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGS

SEQ ID NO. 201.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 202.
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGS

Figure 2Z

XENP11922 H1_L1.31

SEQ ID NO. 203.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVLGSHHHHHH

SEQ ID NO. 204.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVL

SEQ ID NO. 205.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 206.
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVL

XENP11923 H1_L1.32

SEQ ID NO. 207.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVLGSHHHHHH

SEQ ID NO. 208.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

SEQ ID NO. 209.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 210.
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

Figure 2AA

XENP12107 H1.38_L1.4

SEQ ID NO. 211.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 212.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 213.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSS

SEQ ID NO. 214.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12108 H1_L1.33

SEQ ID NO. 215.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLTVLGSHHHHHH

SEQ ID NO. 216.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLTVL

SEQ ID NO. 217.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 218.
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLT

Figure 2BB

XENP12109 H1_L1.34

SEQ ID NO. 219.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGTAPRGLIGGTNKRAPGVPARFSGSLLG
GKAALTLSGAQPEDEAEYYCALWYSNLWVFGGGTKLTVLGSHHHHHH

SEQ ID NO. 220.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGTAPRGLIGGTNKRAPGVPARFSGSLLG
GKAALTLSGAQPEDEAEYYCALWYSNLWVFGGGTKLTVL

SEQ ID NO. 221.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 222.
QAVVTQEPSLTVSPGGTVTLTCGSSTGAVTTSNYANWVQQKPGTAPRGLIGGTNKRAPGVPARFSGSLLG
GKAALTLSGAQPEDEAEYYCALWYSNLWVFGGGTKLTVL

XENP12110 H1_L1.35

SEQ ID NO. 223.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGSPPRGLIGGTNKRAPGVPARFSGSLLG
GKAALTLSGAQPEDEAEYYCALWYSNLWVFGGGTKLTVLGSHHHHHH

SEQ ID NO. 224.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGSPPRGLIGGTNKRAPGVPARFSGSLLG
GKAALTLSGAQPEDEAEYYCALWYSNLWVFGGGTKLTVL

SEQ ID NO. 225.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 226.
QAVVTQEPSLTVSPGGTVTLTCGSSTGAVTTSNYANWVQQKPGSPPRGLIGGTNKRAPGVPARFSGSLLG
GKAALTLSGAQPEDEAEYYCALWYSNLWVFGGGTKLTVL

Figure 2CC

XENP12111 H1_L1.36

SEQ ID NO. 227.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVLGSHHHHHH

SEQ ID NO. 228.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVL

SEQ ID NO. 229.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 230.
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVL

XENP12112 H1_L1.37

SEQ ID NO. 231.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVLGSHHHHHH

SEQ ID NO. 232.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVL

SEQ ID NO. 233.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 234.
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVL

Figure 2DD

XENP12113 H1_L1.38

SEQ ID NO. 235.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVLGSHHHHHH

SEQ ID NO. 236.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVL

SEQ ID NO. 237.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 238.
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVL

XENP12114 H1_L1.39

SEQ ID NO. 239.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVLGSHHHHHH

SEQ ID NO. 240.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVL

SEQ ID NO. 241.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 242.
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVL

Figure 2EE

XENP12131 H1.30_L1.4

SEQ ID NO. 243.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 244.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 245.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 246.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12132 H1.31_L1.4

SEQ ID NO. 247.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 248.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 249.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 250.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2FF

XENP12133 H1.32_L1.4

SEQ ID NO. 251.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 252.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 253.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSS

SEQ ID NO. 254.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12134 H1.33_L1.4

SEQ ID NO. 255.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 256.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 257.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSS

SEQ ID NO. 258.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2GG

XENP12135 H1.34_L1.4

SEQ ID NO. 259.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 260.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 261.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSS

SEQ ID NO. 262.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12136 H1.35_L1.4

SEQ ID NO. 263.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 264.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 265.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 266.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2HH

XENP12137 H1.36_L1.4

SEQ ID NO. 267.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSSGGGGSGGGGSGGGGSQA
VVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVLGSHHHHHH

SEQ ID NO. 268.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSSGGGGSGGGGSGGGGSQA
VVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL

SEQ ID NO. 269.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSS

SEQ ID NO. 270.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12138 H1.37_L1.4

SEQ ID NO. 271.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 272.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 273.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 274.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 2II

XENP12139 H1.37_L1.32

SEQ ID NO. 275.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVLGSHHHHHH

SEQ ID NO. 276.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

SEQ ID NO. 277.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 278.
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

XENP12149 H1_L1.40

SEQ ID NO. 279.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 280.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 281.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 282.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 2JJ

XENP12213 H1.30_L1.40

SEQ ID NO. 283.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 284.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 285.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 286.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

XENP12214 H1.8_L1.40

SEQ ID NO. 287.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 288.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 289.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 290.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 2KK

XENP12215 H1.39_L1.40

SEQ ID NO. 291.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 292.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 293.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 294.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

XENP12216 H1.40_L1.40

SEQ ID NO. 295.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 296.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 297.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 298.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 2LL

XENP12217 H1.30_L1.41

SEQ ID NO. 299.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 300.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 301.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 302.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

XENP12218 H1.8_L1.41

SEQ ID NO. 303.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 304.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 305.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 306.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

Figure 2MM

XENP12219 H1.39_L1.41

SEQ ID NO. 307.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 308.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 309.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 310.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

XENP12220 H1.40_L1.41

SEQ ID NO. 311.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 312.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 313.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 314.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

Figure 2NN

XENP12221 H1.30_L1.42

SEQ ID NO. 315.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 316.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 317.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 318.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

XENP12222 H1.8_L1.42

SEQ ID NO. 319.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 320.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 321.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 322.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

Figure 200

XENP12223 H1.39_L1.42

SEQ ID NO. 323.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 324.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 325.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 326.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

XENP12224 H1.40_L1.42

SEQ ID NO. 327.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 328.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 329.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 330.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

Figure 2PP

XENP12225 H1.30_L1.43

SEQ ID NO. 331.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 332.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 333.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 334.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

XENP12226 H1.8_L1.43

SEQ ID NO. 335.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 336.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 337.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 338.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

Figure 2QQ

XENP12227 H1.39_L1.43

SEQ ID NO. 339.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 340.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 341.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 342.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

XENP12228 H1.40_L1.43

SEQ ID NO. 343.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 344.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 345.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 346.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

Figure 2RR

XENP12229 H1.30_L1.44

SEQ ID NO. 347.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 348.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 349.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 350.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

XENP12230 H1.8_L1.44

SEQ ID NO. 351.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 352.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 353.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 354.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

Figure 2SS

XENP12231 H1.39_L1.44

SEQ ID NO. 355.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 356.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 357.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 358.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

XENP12232 H1.40_L1.44

SEQ ID NO. 359.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 360.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 361.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 362.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

Figure 2TT

XENP12233 H1.30_L1.45

SEQ ID NO. 363.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 364.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 365.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 366.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

XENP12234 H1.8_L1.45

SEQ ID NO. 367.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 368.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 369.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 370.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

Figure 2UU

XENP12235 H1.39_L1.45

SEQ ID NO. 371.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 372.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 373.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 374.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

XENP12236 H1.40_L1.45

SEQ ID NO. 375.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 376.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 377.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 378.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

Figure 2VV

XENP12237 H1.30_L1.46

SEQ ID NO. 379.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 380.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 381.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 382.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

XENP12238 H1.8_L1.46

SEQ ID NO. 383.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 384.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 385.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 386.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

Figure 2WW

XENP12239 H1.39_L1.46

SEQ ID NO. 387.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 388.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 389.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 390.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

XENP12240 H1.40_L1.46

SEQ ID NO. 391.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 392.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 393.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 394.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

Figure 2XX

XENP12241 H1.30_L1.47

SEQ ID NO. 395.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 396.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 397.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 398.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

XENP12242 H1.8_L1.47

SEQ ID NO. 399.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 400.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 401.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 402.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

Figure 2YY

XENP12243 H1.39_L1.47

SEQ ID NO. 403.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 404.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 405.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 406.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

XENP12244 H1.40_L1.47

SEQ ID NO. 407.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 408.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 409.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 410.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

Figure 3A

| XENP | VH ID | VL ID | Yield (mg/L) | $T_m$ (°C) |
|---|---|---|---|---|
| 11502 | H1 | L1.4 | 13.39 | 62.7 |
| 11794 | H1.3 | L1.4 | 4.00 | 62 |
| 11795 | H1.4 | L1.4 | 18.01 | 62.5 |
| 11796 | H1.5 | L1.4 | 0.15 | 61.5 |
| 11801 | H1.6 | L1.4 | 2.13 | 62.5 |
| 11802 | H1.7 | L1.4 | 14.66 | 62.25 |
| 11803 | H1.8 | L1.4 | 1.85 | 64.125 |
| 11804 | H1.9 | L1.4 | 20.57 | 65 |
| 11805 | H1.10 | L1.4 | 29.45 | 68.5 |
| 11806 | H1.11 | L1.4 | 1.71 | 59.75 |
| 11807 | H1.12 | L1.4 | 6.27 | 63.375 |
| 11808 | H1.13 | L1.4 | 9.70 | 62.375 |
| 11809 | H1.14 | L1.4 | 3.22 | 63 |
| 11810 | H1.15 | L1.4 | 15.38 | 62 |
| 11811 | H1.16 | L1.4 | 3.98 | 58 |
| 11812 | H1.17 | L1.4 | 0.16 | 60 |
| 11813 | H1.18 | L1.4 | 9.09 | 61 |
| 11814 | H1.19 | L1.4 | 2.53 | 62 |
| 11815 | H1.20 | L1.4 | 5.29 | 62.5 |
| 11816 | H1.21 | L1.4 | 19.89 | 62 |
| 11817 | H1.22 | L1.4 | 7.38 | 59 |
| 11818 | H1.23 | L1.4 | 7.90 | 62 |
| 11819 | H1.24 | L1.4 | 3.10 | 63.125 |
| 11820 | H1.25 | L1.4 | 4.57 | 61.875 |
| 11821 | H1.26 | L1.4 | 57.12 | 61.5 |
| 11822 | H1.27 | L1.4 | 25.53 | 65.5 |
| 11823 | H1.28 | L1.4 | 6.66 | 62.5 |
| 11824 | H1.29 | L1.30 | 30.48 | 61 |
| 11825 | H1 | L1.10 | 18.02 | 62 |
| 11826 | H1 | L1.11 | 6.36 | 62.5 |
| 11827 | H1 | L1.12 | 19.82 | 61.75 |
| 11828 | H1 | L1.13 | 2.22 | 62 |
| 11829 | H1 | L1.14 | 20.47 | 62.5 |
| 11830 | H1 | L1.15 | 20.63 | 62 |
| 11831 | H1 | L1.16 | 34.29 | 61.75 |
| 11832 | H1 | L1.17 | 17.89 | 62.25 |
| 11833 | H1 | L1.18 | 3.85 | 60 |
| 11834 | H1 | L1.19 | 6.02 | 60.75 |
| 11835 | H1 | L1.20 | 22.46 | 62.5 |
| 11836 | H1 | L1.21 | 8.16 | 55 |
| 11837 | H1 | L1.22 | 3.51 | 56.75 |
| 11838 | H1 | L1.23 | 15.90 | 63.5 |

Figure 3B

| XENP | VH ID | VL ID | Yield (mg/L) | $T_m$ (°C) |
|---|---|---|---|---|
| 11839 | H1 | L1.24 | 15.94 | 61.75 |
| 11840 | H1 | L1.25 | 15.11 | 61.5 |
| 11841 | H1 | L1.26 | 7.30 | 64 |
| 11842 | H1 | L1.27 | 4.39 | 57.5 |
| 11843 | H1 | L1.28 | 15.61 | 62.875 |
| 11844 | H1 | L1.29 | 12.74 | 61.5 |
| 11920 | H1 | L3.1 | 0.72 | 52 |
| 11921 | H1 | L5.1 | 1.88 | 55.5 |
| 11922 | H1 | L1.31 | 8.89 | 58.25 |
| 11923 | H1 | L1.32 | 5.02 | 58.25 |
| 12107 | H1.38 | L1.4 | 19.28 | 62.5 |
| 12108 | H1 | L1.33 | 14.77 | 63 |
| 12109 | H1 | L1.34 | 10.77 | 62 |
| 12110 | H1 | L1.35 | 11.61 | 62.5 |
| 12111 | H1 | L1.36 | 17.51 | 62.5 |
| 12112 | H1 | L1.37 | 13.42 | 61 |
| 12113 | H1 | L1.38 | 13.03 | 63 |
| 12114 | H1 | L1.39 | 9.78 | 55.5 |
| 12131 | H1.30 | L1.4 | 12.73 | 65 |
| 12132 | H1.31 | L1.4 | 31.88 | 71 |
| 12133 | H1.32 | L1.4 | 24.00 | 65.5 |
| 12134 | H1.33 | L1.4 | 26.84 | 67.5 |
| 12135 | H1.34 | L1.4 | 40.40 | 72.5 |
| 12136 | H1.35 | L1.4 | 8.34 | 60.5 |
| 12137 | H1.36 | L1.4 | 4.30 | 60 |
| 12138 | H1.37 | L1.4 | 14.19 | 64.75 |
| 12139 | H1.37 | L1.32 | 6.75 | 63.5 |
| 12149 | H1 | L1.40 | 58.86 | 65.5 |

Figure 4A

| XENP | % Improvement from H1_L1.4 |
|---|---|
| 11796 | 125.1 |
| 11803 | 118.0 |
| 11804 | 12.2 |
| 11805 | 16.3 |
| 11807 | 31.6 |
| 11808 | 54.4 |
| 11809 | 40.2 |
| 11502 | 129.3 |
| 11819 | 69.2 |
| 11820 | 98.8 |
| 11822 | 7.6 |
| 11838 | 169.8 |
| 11841 | 95.1 |
| 11843 | 152.5 |
| 11794 | 112.1 |
| 11795 | 241.8 |
| 11801 | 77.1 |
| 11802 | 232.6 |
| 11806 | 93.8 |
| 11810 | 263.9 |
| 11811 | 42.4 |
| 11812 | 5.1 |
| 11813 | 107.4 |
| 11814 | 83.8 |
| 11815 | 173.6 |
| 11816 | 230.7 |
| 11817 | 46.4 |
| 11818 | 33.3 |
| 11823 | 127.3 |
| 11825 | 227.4 |
| 11826 | 137.3 |
| 11827 | 197.1 |
| 11828 | 82.3 |
| 11829 | 225.4 |
| 11830 | 206.7 |
| 11832 | 79.9 |
| 11833 | 35.7 |
| 11834 | 66.9 |
| 11835 | 194.7 |

Figure 4B

| XENP | % Improvement from H1_L1.4 |
|---|---|
| 11836 | 191.6 |
| 11837 | 73.9 |
| 11839 | 212.5 |
| 11840 | 204.0 |
| 11842 | 3.4 |
| 11844 | 112.3 |
| 12131 | 29.0 |
| 12132 | 0.1 |
| 12133 | 10.4 |
| 12134 | 1.0 |
| 12136 | 64.4 |
| 12137 | 0.1 |
| 12138 | 108.9 |
| 12108 | 145.2 |
| 12113 | 112.9 |
| 12149 | 128.7 |

Figure 5 scFv Linkers

```
GGGGSGGGGSGGGGS      (SEQ ID NO: 678)
GGGGSGGGGSGGGGSGGGGS (SEQ ID NO: 679)
GSTSGSGKPGSGEGSTKG   (SEQ ID NO: 680)
PRGASKSGSASQTGSAPGS  (SEQ ID NO: 681)
GTAAAGAGAAGGAAAGAAG  (SEQ ID NO: 682)
GTSGSSGSGSGGSGSGGGG  (SEQ ID NO: 683)
```

Figure 6

HUMAN T-cell surface glycoprotein CD3 epsilon chain (SEQ ID NO: 684)

MQSGTHWRVLGLCLLSVGVWGQDGNEEMGGITQTPYKVSISGTTVILTCPQYPG
SEILWQHNDKNIGGDEDDKNIGSDEDHLSLKEFSELEQSGYYVCYPRGSK
PEDANFYLYLRARVCENCMEMDVMSVATIVIVDICITGGLLLLVYYWSK
NRKAKAKPVTRGAGAGGRQRGQNKERPPPVPNPDYEPIRKGQRDLYSGL
NQRRI

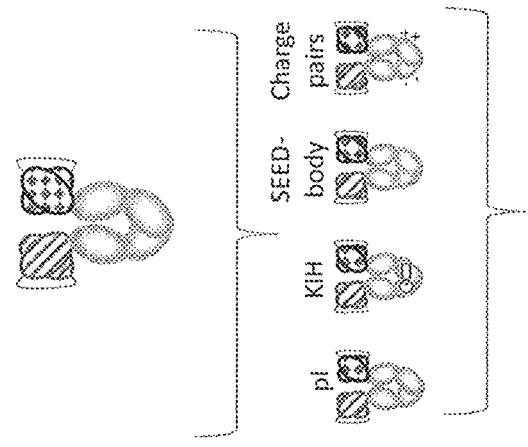

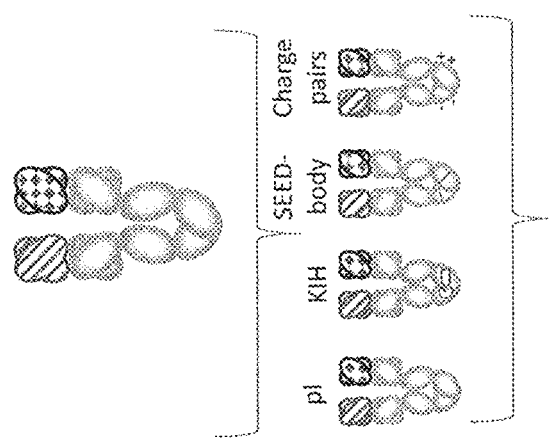

one scFv is anti-CD3 scFv from Figure 2 one scFv is anti-CD3 scFv from Figure 2 one scFv is anti-CD3 scFv from Figure 2

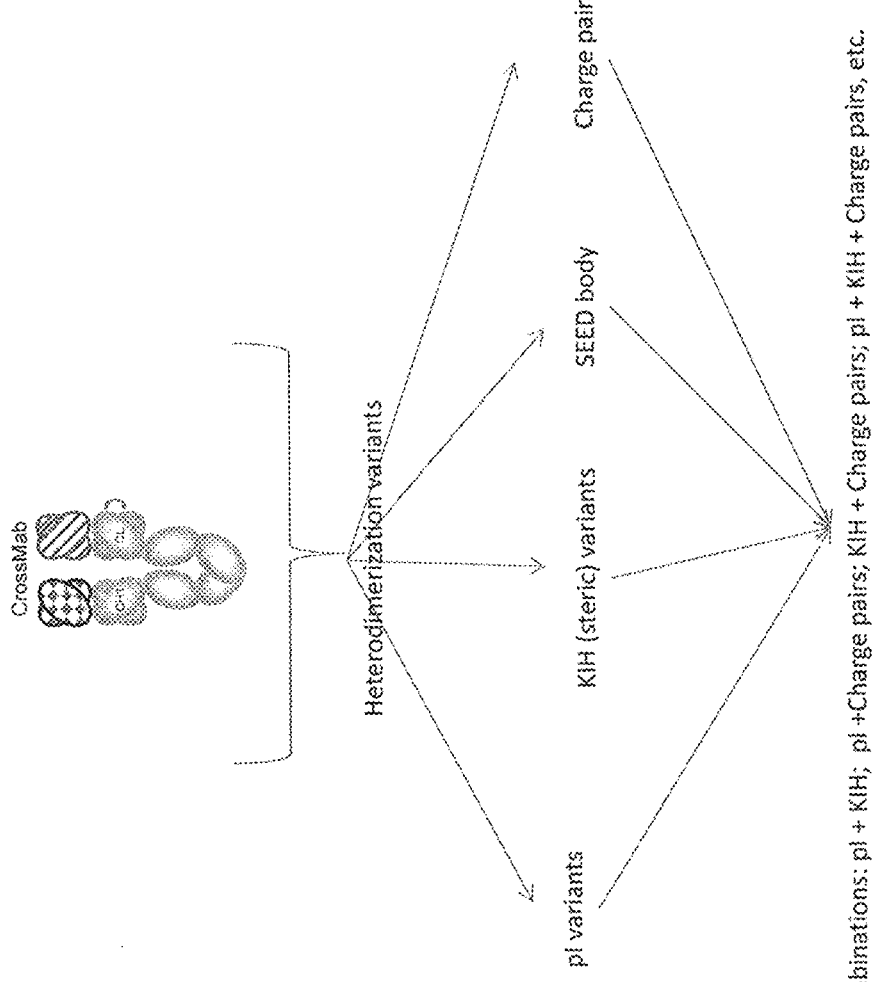

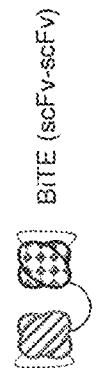
Figure 7N
Figure 7O
Figure 7P
Figure 7Q
Figure 7R

Figure 12A

Preferred steric variants that favor Fc heterodimerization.

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 12B

Specifically preferred steric variants that favor Fc heterodimerization.

| Variant 1 | Variant 2 |
|---|---|
| F405A | T394F |
| S364D | Y349K |
| S364E | Y349K |
| S364H | Y349T |
| L351K | L351E |
| D401K | T411E |
| S364D/T394F | Y349K/F405A |
| S364E/F405A | Y349K/T394F |
| S364H/D401K | Y349T/T411E |
| S364H/F405A | Y349T/T394F |
| S364H/T394F | Y349T/F405A |
| L351K/S364H/D401K | Y349T/L351E/T411E |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 13A

PREFERRED HETERODIMERIZATION VARIANTS

| Fc monomer 1 substitutions | Fc monomer 2 substitutions |
|---|---|
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| I199T/N203D/K247Q/R355Q/N384S/K392N/V397M/Q419E/K447_ (deletion of K447) | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |

Figure 13B

| | |
|---|---|
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 14

| Fc monomer 1 substitutions | Fc monomer 2 substitutions |
|---|---|
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N203D/K247Q/R355Q/N384S/K392N/V397M/Q419E/K447_ | Q196K/P217R/P228R/N276K |
| N203D/K247Q/R355Q/N384S/K392N/V397M/Q419E/K447_ | Q196K/N276K |
| N203D/K247Q/R355Q/N384S/K392N/Q419E/K447_ | Q196K/P217R/P228R/N276K |
| N203D/K247Q/R355Q/N384S/K392N/Q419E/K447_ | Q196K/N276K |

FIGURE 15

COMBINATIONS OF HETERODIMERIZATION VARIANTS AND scFvs INTO HETERODIMERIZATION FORMATS

| Heterodimerization format | FcRn variants Monomer 1 and/or Monomer 2 | Fc variants Monomer 1 and/or Monomer 2 | pI variants | Steric variants (including charge pairs) | Anti-CD3 scFv | Combinations (See Legend E) |
|---|---|---|---|---|---|---|
| Dual scFv-Fv (Fig 7A) | See Legend A | See Legend B | See Legend C | See Legend D | Any from Figure 2 | 1), 2), 3), 4), 5),6), 7), 8), 9) and 10) |
| Bispecific IgG (Fig 7B) | See Legend A | See Legend B | See Legend C | See Legend D | Any from Figure 2 | 1), 2), 3), 4), 5),6), 7), 8), 9) and 10) |
| One-armed DVD-Ig (Fig 7C) | See Legend A | See Legend B | See Legend C | See Legend D | Any from Figure 2 | 1), 2), 3), 4), 5),6), 7), 8), 9) and 10) |
| Heterodimeric DVD-Ig (Fig 7D) | See Legend A | See Legend B | See Legend C | See Legend D | Any from Figure 2 | 1), 2), 3), 4), 5),6), 7), 8), 9) and 10) |
| mAb-Fv (Fig 7E) | See Legend A | See Legend B | See Legend C | See Legend D | Any from Figure 2 | 1), 2), 3), 4), 5),6), 7), 8), 9) and 10) |
| Multi-scFv (Fig 7F) | See Legend A | See Legend B | See Legend C | See Legend D | Any from Figure 2 | 1), 2), 3), 4), 5),6), 7), 8), 9) and 10) |
| Heterodimeric Fab-Fc (Fig 7G) | See Legend A | See Legend B | See Legend C | See Legend D | Any from Figure 2 | 1), 2), 3), 4), 5),6), 7), 8), 9) and 10) |
| One-armed Fab-Fc (Fig 7H) | See Legend A | See Legend B | See Legend C | See Legend D | Any from Figure 2 | 1), 2), 3), 4), 5),6), 7), 8), 9) and 10) |
| One-armed scFv-Fc (Fig 7I) | See Legend A | See Legend B | See Legend C | See Legend D | Any from Figure 2 | 1), 2), 3), 4), 5),6), 7), 8), 9) and 10) |
| scFv-CH3 (Fig 7J) | See Legend A | See Legend B | See Legend C | See Legend D | Any from Figure 2 | 1), 2), 3), 4), 5),6), 7), 8), 9) and 10) |
| mAb-scFv (Fig 7K) | See Legend A | See Legend B | See Legend C | See Legend D | Any from Figure 2 | 1), 2), 3), 4), 5),6), 7), 8), 9) and 10) |
| mAb-scFv (Fig 7L) | See Legend A | See Legend B | See Legend C | See Legend D | Any from Figure 2 | 1), 2), 3), 4), 5),6), 7), 8), 9) and 10) |
| CrossMab (Fig 7N) | See Legend A | See Legend B | See Legend C | See Legend D | Any from Figure 2 | 1), 2), 3), 4), 5),6), 7), 8), 9) and 10) |
| IgG Antibody (Fig 8A) | See Legend A | See Legend B | See Legend C | See Legend D | Any from Figure 2 | 1), 2), 3), 4), 5),6), 7), 8), 9) and 10) |
| mAb-Fv (Fig 8B) | See Legend A | See Legend B | See Legend C | See Legend D | Any from Figure 2 | 1), 2), 3), 4), 5),6), 7), 8), 9) and 10) |
| mAb-Fab (Fig 8C) | See Legend A | See Legend B | See Legend C | See Legend D | Any from Figure 2 | 1), 2), 3), 4), 5),6), 7), 8), 9) and 10) |
| Fab-Fv (Fig 8D) | See Legend A | See Legend B | See Legend C | See Legend D | Any from Figure 2 | 1), 2), 3), 4), 5),6), 7), 8), 9) and 10) |
| Fab-Fab (Fig 8E) | See Legend A | See Legend B | See Legend C | See Legend D | Any from Figure 2 | 1), 2), 3), 4), 5),6), 7), 8), 9) and 10) |
| Bottle opener (Fig 9B) | See Legend A | See Legend B | See Legend C | See Legend D | Any from Figure 2 | 1), 2), 3), 4), 5),6), 7), 8), 9) and 10) |
| Central-mAb (Fig 16B) | See Legend A | See Legend B | See Legend C | See Legend D | Any from Figure 2 | 1), 2), 3), 4), 5),6), 7), 8), 9) and 10) |

Figure 17A

Optimized scFv CD3 variable regions

| Xen # | vhCDR1 | vhCDR2 | vhCDR3 | vlCDR1 | vlCDR2 | vlCDR3 |
|---|---|---|---|---|---|---|
| XENP11502 H1_L1.4 SEQ ID NO: 4 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11794 H1.3_L1.4 SEQ ID NO: 8 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11795 H1.4_L1.4 SEQ ID NO: 12 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11796 H1.5_L1.4 SEQ ID NO: 16 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11801 H1.6_L1.4 SEQ ID NO: 20 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11802 H1.7_L1.4 SEQ ID NO: 24 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11803 H1.8_L1.4 SEQ ID NO: 28 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11804 H1.9_L1.4 SEQ ID NO: 32 | TYAMN SEQ ID NO: 432 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11805 H1.10_L1.4 SEQ ID NO: 36 | TYAMS SEQ ID NO: 412 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11806 H1.11_L1.4 SEQ ID NO: 40 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11807 H1.12_L1.4 SEQ ID NO: 44 | TYAMN SEQ ID NO: 411 | RIRSKANNYATYYADSVKG SEQ ID NO: 414 | HGNFGNSYYSWFAY SEQ ID NO: 416 | GSSTGAVTTSNYAN SEQ ID NO: 420 | GTNKRAP SEQ ID NO: 425 | ALWYSNLWV SEQ ID NO: 430 |

Figure 17B

| Xen # | vhCDR1 | vhCDR2 | vhCDR3 | vlCDR1 | vlCDR2 | vlCDR3 |
|---|---|---|---|---|---|---|
| XENP11808 H1.13_L1.4 SEQ ID NO: 48 | TYAMN SEQ ID NO: 411 | RIRSKANSYATYYADSVKG SEQ ID NO: 434 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11809 H1.14_L1.4 SEQ ID NO: 52 | TYAMN SEQ ID NO: 411 | RIRSKYNNYATAYADSVKG SEQ ID NO: 478 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11810 H1.15_L1.4 SEQ ID NO: 56 | TYAMN SEQ ID NO: 411 | RIRSKYNNYATYYAASVKG SEQ ID NO: 479 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11811 H1.16_L1.4 SEQ ID NO: 60 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11812 H1.17_L1.4 SEQ ID NO: 64 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11813 H1.18_L1.4 SEQ ID NO: 68 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11814 H1.19_L1.4 SEQ ID NO: 72 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11815 H1.20_L1.4 SEQ ID NO: 76 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11816 H1.21_L1.4 SEQ ID NO: 80 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11817 H1.22_L1.4 SEQ ID NO: 84 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11818 H1.23_L1.4 SEQ ID NO: 88 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11819 H1.24_L1.4 SEQ ID NO: 92 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |

Figure 17C

| Xen # | vhCDR1 | vhCDR2 | vhCDR3 | vlCDR1 | vlCDR2 | vlCDR3 |
|---|---|---|---|---|---|---|
| XENP11820 H1.25_L1.4 SEQ ID NO: 96 | TYAMN SEQ ID NO: 411 | RIRSKYNNYATYYADSVKG SEQ ID NO: 413 | HGNFGQSYVSWFAY SEQ ID NO: 418 | GSSTGAVTTSNYAN SEQ ID NO: 420 | GTNKRAP SEQ ID NO: 425 | ALWYSNLWV SEQ ID NO: 430 |
| XENP11821 H1.26_L1.4 SEQ ID NO: 100 | TYAMN SEQ ID NO: 411 | RIRSKYNNYATYYADSVKG SEQ ID NO: 413 | HGNFGNTYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11822 H1.27_L1.4 SEQ ID NO: 104 | TYAMN SEQ ID NO: 411 | RIRSKYNNYATYYADSVKG SEQ ID NO: 413 | HGNFGNSYVSWFDY SEQ ID NO: 480 | GSSTGAVTTSNYAN SEQ ID NO: 420 | GTNKRAP SEQ ID NO: 425 | ALWYSNLWV SEQ ID NO: 430 |
| XENP11823 H1.28_L1.4 SEQ ID NO: 108 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11824 H1.29_L1.30 SEQ ID NO: 112 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11825 H1_L1.11 SEQ ID NO: 116 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11826 H1_L1.11 SEQ ID NO: 120 | TYAMN SEQ ID NO: 411 | RIRSKYNNYATYYADSVKG SEQ ID NO: 413 | HGNFGNSYVSWFAY SEQ ID NO: 415 | GSSTGAVTTSNYAN SEQ ID NO: 420 | GTNKRAP SEQ ID NO: 425 | ALWYSNLWV SEQ ID NO: 430 |
| XENP11827 H1_L1.12 SEQ ID NO: 124 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11828 H1_L1.13 SEQ ID NO: 128 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11829 H1_L1.14 SEQ ID NO: 132 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 421 | GTNKRAP SEQ ID NO: 425 | ALWYSNLWV SEQ ID NO: 430 |
| XENP11830 H1_L1.15 SEQ ID NO: 136 | TYAMN SEQ ID NO: 411 | RIRSKYNNYATYYADSVKG SEQ ID NO: 413 | HGNFGNSYVSWFAY SEQ ID NO: 416 | GSSTGAVTSGHYAN SEQ ID NO: 422 | GTNKRAP SEQ ID NO: 425 | ALWYSNLWV SEQ ID NO: 430 |
| XENP11831 H1_L1.16 SEQ ID NO: 140 | TYAMN SEQ ID NO: 411 | RIRSKYNNYATYYADSVKG SEQ ID NO: 413 | HGNFGNSYVSWFAY SEQ ID NO: 416 | GSSTGAVTSNYAN SEQ ID NO: 420 | DTNKRAP SEQ ID NO: 426 | ALWYSNLWV SEQ ID NO: 430 |

Figure 17D

| Xen # | vhCDR1 | vhCDR2 | vhCDR3 | vlCDR1 | vlCDR2 | vlCDR3 |
|---|---|---|---|---|---|---|
| XENP11832 H1_L1.17 SEQ ID NO: 144 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNMRAP SEQ ID NO: 427 | ALWYSNLWV SEQ ID NO: 430 |
| XENP11833 H1_L1.18 SEQ ID NO: 148 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAS SEQ ID NO: 428 | ALWYSNLWV SEQ ID NO: 430 |
| XENP11834 H1_L1.19 SEQ ID NO: 152 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTSNKHS SEQ ID NO: 482 | ALWYSNLWV SEQ ID NO: 430 |
| XENP11835 H1_L1.20 SEQ ID NO: 156 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11836 H1_L1.21 SEQ ID NO: 160 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11837 H1_L1.22 SEQ ID NO: 164 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11838 H1_L1.23 SEQ ID NO: 168 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11839 H1_L1.24 SEQ ID NO: 172 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11840 H1_L1.25 SEQ ID NO: 176 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11841 H1_L1.26 SEQ ID NO: 180 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11842 H1_L1.27 SEQ ID NO: 184 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | LLWYSNLWV SEQ ID NO: 417 |
| XENP11843 H1_L1.28 SEQ ID NO: 188 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |

Figure 17E

| Xen # | vhCDR1 | vhCDR2 | vhCDR3 | vlCDR1 | vlCDR2 | vlCDR3 |
|---|---|---|---|---|---|---|
| XENP11844 H1_L1.29 SEQ ID NO: 192 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11920 H1_L3.1 SEQ ID NO: 196 | TYAMN SEQ ID NO: 411 | RIRSKYNNYATYYADSVKG SEQ ID NO: 413 | HGNFGNSYVSWFAY SEQ ID NO: 416 | RSSTGAVTTSNYAN SEQ ID NO: 423 | GTNKRAP SEQ ID NO: 425 | ALWYSNLWV SEQ ID NO: 430 |
| XENP11921 H1_L5.1 SEQ ID NO: 200 | TYAMN SEQ ID NO: 411 | RIRSKYNNYATYYADSVKG SEQ ID NO: 413 | HGNFGNSYVSWFAY SEQ ID NO: 416 | KSSTGAVTTSNYAN SEQ ID NO: 424 | GTNKRAP SEQ ID NO: 425 | ALWYSNLWV SEQ ID NO: 430 |
| XENP11922 H1_L1.31 SEQ ID NO: 204 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP11923 H1_L1.32 SEQ ID NO: 208 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12107 H1.38_L1.4 SEQ ID NO: 212 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12108 H1_L1.33 SEQ ID NO: 216 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12109 H1_L1.34 SEQ ID NO: 220 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12110 H1_L1.35 SEQ ID NO: 224 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12111 H1_L1.36 SEQ ID NO: 228 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12112 H1_L1.37 SEQ ID NO: 232 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12113 H1_L1.38 SEQ ID NO: 236 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |

Figure 17F

| Xen # | vhCDR1 | vhCDR2 | vhCDR3 | vlCDR1 | vlCDR2 | vlCDR3 |
|---|---|---|---|---|---|---|
| XENP12114 H1_L1.39<br>SEQ ID NO: 240 | TYAMN<br>SEQ ID NO: 411 | RIRSKYNNYATYYADSVKG<br>SEQ ID NO: 413 | HGNFGNSYVSWFAY<br>SEQ ID NO: 416 | GSSTGAVTTSNYAN<br>SEQ ID NO: 420 | GTNKRAP<br>SEQ ID NO: 425 | ALWYSNLWV<br>SEQ ID NO: 430 |
| XENP12131 H1.30_L1.4<br>SEQ ID NO: 244 | TYAMN<br>SEQ ID NO: 411 | RIRSKYNNYATYYADSVKG<br>SEQ ID NO: 413 | HGNFGDSYVSWFAY<br>SEQ ID NO: 417 | GSSTGAVTTSNYAN<br>SEQ ID NO: 420 | GTNKRAP<br>SEQ ID NO: 425 | ALWYSNLWV<br>SEQ ID NO: 430 |
| XENP12132 H1.31_L1.4<br>SEQ ID NO: 248 | TYAMS<br>SEQ ID NO: 412 | RIRSKYNNYATYYADSVKG<br>SEQ ID NO: 413 | HGNFGDSYVSWFAY<br>SEQ ID NO: 417 | GSSTGAVTTSNYAN<br>SEQ ID NO: 420 | GTNKRAP<br>SEQ ID NO: 425 | ALWYSNLWV<br>SEQ ID NO: 430 |
| XENP12133 H1.32_L1.4<br>SEQ ID NO: 252 | TYAMN<br>SEQ ID NO: 411 | RIRSKANNYATYYADSVKG<br>SEQ ID NO: 414 | HGNFGDSYVSWFAY<br>SEQ ID NO: 417 | GSSTGAVTTSNYAN<br>SEQ ID NO: 420 | GTNKRAP<br>SEQ ID NO: 425 | ALWYSNLWV<br>SEQ ID NO: 430 |
| XENP12134 H1.33_L1.4<br>SEQ ID NO: 256 | TYAMS<br>SEQ ID NO: 412 | RIRSKANNYATYYADSVKG<br>SEQ ID NO: 414 | HGNFGDSYVSWFDY<br>SEQ ID NO: 419 | GSSTGAVTTSNYAN<br>SEQ ID NO: 420 | GTNKRAP<br>SEQ ID NO: 425 | ALWYSNLWV<br>SEQ ID NO: 430 |
| XENP12135 H1.34_L1.4<br>SEQ ID NO: 260 | TYAMN<br>SEQ ID NO: 411 | RIRSKYNNYATYYADSVKG<br>SEQ ID NO: 413 | HGNFGDSYVSWFDY<br>SEQ ID NO: 419 | GSSTGAVTTSNYAN<br>SEQ ID NO: 420 | GTNKRAP<br>SEQ ID NO: 425 | ALWYSNLWV<br>SEQ ID NO: 430 |
| XENP12136 H1.35_L1.4<br>SEQ ID NO: 264 | TYAMN<br>SEQ ID NO: 411 | RIRSKYNNYATYYADSVKG<br>SEQ ID NO: 413 | HGNFGNSYVSWFAY<br>SEQ ID NO: 416 | GSSTGAVTTSNYAN<br>SEQ ID NO: 420 | GTNKRAP<br>SEQ ID NO: 425 | ALWYSNLWV<br>SEQ ID NO: 430 |
| XENP12137 H1.36_L1.4<br>SEQ ID NO: 268 | TYAMN<br>SEQ ID NO: 411 | RIRSNGGSTYYADSVKG<br>SEQ ID NO: 415 | HGNFGNSYVSWFAY<br>SEQ ID NO: 416 | GSSTGAVTTSNYAN<br>SEQ ID NO: 420 | GTNKRAP<br>SEQ ID NO: 425 | ALWYSNLWV<br>SEQ ID NO: 430 |
| XENP12138 H1.37_L1.4<br>SEQ ID NO: 272 | TYAMN<br>SEQ ID NO: 411 | RIRSKYNNYATYYADSVKG<br>SEQ ID NO: 413 | HGNFGNSYVSWFAY<br>SEQ ID NO: 416 | GSSTGAVTTSNYAN<br>SEQ ID NO: 420 | GTNKRAP<br>SEQ ID NO: 425 | ALWYSNLWV<br>SEQ ID NO: 430 |
| XENP12139 H1.37_L1.32<br>SEQ ID NO: 276 | TYAMN<br>SEQ ID NO: 411 | RIRSKYNNYATYYADSVKG<br>SEQ ID NO: 413 | HGNFGDSYVSWFAY<br>SEQ ID NO: 417 | GSSTGAVTTSNYAN<br>SEQ ID NO: 420 | GTNKRAP<br>SEQ ID NO: 425 | ALWYSNLWV<br>SEQ ID NO: 430 |
| XENP12149 H1.40<br>SEQ ID NO: 280 | TYAMN<br>SEQ ID NO: 411 | RIRSKYNNYATYYADSVKG<br>SEQ ID NO: 413 | HGNFGNSYVSWFAY<br>SEQ ID NO: 416 | GSSTGAVTTSNYAN<br>SEQ ID NO: 420 | GTNKRAP<br>SEQ ID NO: 425 | ALWYSNHWV<br>SEQ ID NO: 433 |
| XENP12213 H1.30_L1.40<br>SEQ ID NO: 284 | TYAMN<br>SEQ ID NO: 411 | RIRSKYNNYATYYADSVKG<br>SEQ ID NO: 413 | HGNFGDSYVSWFAY<br>SEQ ID NO: 417 | GSSTGAVTTSNYAN<br>SEQ ID NO: 420 | GTNKRAP<br>SEQ ID NO: 425 | ALWYSNHWV<br>SEQ ID NO: 433 |

Figure 17G

| Xen # | vhCDR1 | vhCDR2 | vhCDR3 | vlCDR1 | vlCDR2 | vlCDR3 |
|---|---|---|---|---|---|---|
| XENP12214 H1.8_L1.40 SEQ ID NO: 288 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12215 H1.39_L1.40 SEQ ID NO: 292 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12216 H1.40_L1.40 SEQ ID NO: 296 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12217 H1.30_L1.41 SEQ ID NO: 300 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12218 H1.8_L1.41 SEQ ID NO: 304 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12219 H1.39_L1.41 SEQ ID NO: 308 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12220 H1.40_L1.41 SEQ ID NO: 312 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12221 H1.30_L1.42 SEQ ID NO: 316 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12222 H1.8_L1.42 SEQ ID NO: 320 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12223 H1.39_L1.42 SEQ ID NO: 324 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12224 H1.40_L1.42 SEQ ID NO: 328 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12225 H1.30_L1.43 SEQ ID NO: 332 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 17H

| Xen # | vhCDR1 | vhCDR2 | vhCDR3 | vlCDR1 | vlCDR2 | vlCDR3 |
|---|---|---|---|---|---|---|
| XENP12226 H1.8_L1.43 SEQ ID NO: 336 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12227 H1.39_L1.43 SEQ ID NO: 340 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12228 H1.40_L1.43 SEQ ID NO: 344 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12229 H1.30_L1.43 SEQ ID NO: 348 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12230 H1.8_L1.44 SEQ ID NO: 352 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12231 H1.39_L1.44 SEQ ID NO: 356 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12232 H1.40_L1.44 SEQ ID NO: 360 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12233 H1.30_L1.45 SEQ ID NO: 364 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12234 H1.8_L1.45 SEQ ID NO: 368 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12235 H1.39_L1.45 SEQ ID NO: 372 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12236 H1.40_L1.45 SEQ ID NO: 376 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12237 H1.30_L1.46 SEQ ID NO: 380 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 17I

| Xen # | vhCDR1 | vhCDR2 | vhCDR3 | vlCDR1 | vlCDR2 | vlCDR3 |
|---|---|---|---|---|---|---|
| XENP12238 H1.8_L1.46 SEQ ID NO: 384 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12239 H1.39_L1.46 SEQ ID NO: 388 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12240 H1.40_L1.46 SEQ ID NO: 392 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12241 H1.30_L1.47 SEQ ID NO: 396 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12242 H1.8_L1.47 SEQ ID NO: 400 | TYAMN SEQ ID NO: 411 | RIRSKYNNYATYYADSVKG SEQ ID NO: 413 | HGNFGNSYYSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12243 H1.39_L1.47 SEQ ID NO: 404 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12244 H1.40_L1.47 SEQ ID NO: 408 | TYAMN SEQ ID NO: 411 | RIRSKYNNYATYYADSVKG SEQ ID NO: 413 | HGNFGDSYYSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP ?? SEQ ID NO: 1 and 2 Consensus sequences | TYAMXaa1, wherein Xaa1 is N, S or H (SEQ ID NO:435) | R-I-R-S-K-Xaa1-N-Xaa2-Y-A-T-Xaa3-Y-Y-A-Xaa4-S-V-K-G, wherein Xaa1 is Y or A, Xaa2 is N or S, Xaa3 is Y or A and Xaa4 is D or A (SEQ ID NO:436) | H-G-N-F-G-Xaa1-S-Y-Y-S-W-F-Xaa2-Y, wherein Xaa1 is N, D or Q and Xaa2 is A or D (SEQ ID NO:437) | Xaa1-S-S-T-G-A-V-T-Xaa2-Xaa3-Xaa4-Y-A-N, wherein Xaa1 is G, R or K, Xaa2 is T or S, Xaa3 is S or G and Xaa4 is N or H, (SEQ ID NO:438) | Xaa1-T-N-Xaa2-R-A-Xaa3, wherein Xaa1 is G or D, Xaa2 is K or N, and Xaa3 is P or S (SEQ ID NO:439) | Xaa1-L-W-Y-S-N-Xaa2-W-V, wherein Xaa1 is A or L and Xaa2 is L or H (SEQ ID NO:440) |

Figure 18A

| Variant | # of sub(s) | pI / pI | pI / WT | WT / WT | avg delta pI |
|---|---|---|---|---|---|
| G137E/N203D/K274Q/R355Q/K392N/Q419E/K447_ | 7 | 6.43 | 7.14 | 8.02 | -0.79 |
| G137E/N203D/K274Q/R355Q/K392N/Q419E | 6 | 6.58 | 7.30 | 8.02 | -0.72 |
| G137E/N203D/K274Q/R355Q/K392N/K447_ | 6 | 6.58 | 7.30 | 8.02 | -0.72 |
| G137E/N203D/K274Q/R355Q/Q419E/K447_ | 6 | 6.58 | 7.30 | 8.02 | -0.72 |
| G137E/N203D/K274Q/K392N/Q419E/K447_ | 6 | 6.58 | 7.30 | 8.02 | -0.72 |
| G137E/N203D/R355Q/K392N/Q419E/K447_ | 6 | 6.58 | 7.30 | 8.02 | -0.72 |
| G137E/K274Q/R355Q/K392N/Q419E/K447_ | 6 | 6.58 | 7.30 | 8.02 | -0.72 |
| N203D/K274Q/R355Q/K392N/Q419E/K447_ | 6 | 6.58 | 7.30 | 8.02 | -0.72 |
| G137E/N203D/K274Q/R355Q/K392N | 5 | 6.76 | 7.46 | 8.02 | -0.63 |
| G137E/N203D/K274Q/R355Q/Q419E | 5 | 6.76 | 7.46 | 8.02 | -0.63 |
| G137E/N203D/K274Q/R355Q/K447_ | 5 | 6.76 | 7.46 | 8.02 | -0.63 |
| G137E/N203D/K274Q/K392N/Q419E | 5 | 6.76 | 7.46 | 8.02 | -0.63 |
| G137E/N203D/K274Q/K392N/K447_ | 5 | 6.76 | 7.46 | 8.02 | -0.63 |
| G137E/N203D/K274Q/Q419E/K447_ | 5 | 6.76 | 7.46 | 8.02 | -0.63 |
| G137E/N203D/R355Q/K392N/Q419E | 5 | 6.76 | 7.46 | 8.02 | -0.63 |
| G137E/N203D/R355Q/K392N/K447_ | 5 | 6.76 | 7.46 | 8.02 | -0.63 |
| G137E/N203D/R355Q/Q419E/K447_ | 5 | 6.76 | 7.46 | 8.02 | -0.63 |
| G137E/N203D/K392N/Q419E/K447_ | 5 | 6.76 | 7.46 | 8.02 | -0.63 |
| G137E/K274Q/R355Q/K392N/Q419E | 5 | 6.76 | 7.46 | 8.02 | -0.63 |
| G137E/K274Q/R355Q/K392N/K447_ | 5 | 6.76 | 7.46 | 8.02 | -0.63 |
| G137E/K274Q/R355Q/Q419E/K447_ | 5 | 6.76 | 7.46 | 8.02 | -0.63 |
| G137E/K274Q/K392N/Q419E/K447_ | 5 | 6.76 | 7.46 | 8.02 | -0.63 |
| G137E/R355Q/K392N/Q419E/K447_ | 5 | 6.76 | 7.46 | 8.02 | -0.63 |
| N203D/K274Q/R355Q/K392N/Q419E | 5 | 6.76 | 7.46 | 8.02 | -0.63 |
| N203D/K274Q/R355Q/K392N/K447_ | 5 | 6.76 | 7.46 | 8.02 | -0.63 |
| N203D/K274Q/R355Q/Q419E/K447_ | 5 | 6.76 | 7.46 | 8.02 | -0.63 |
| N203D/K274Q/K392N/Q419E/K447_ | 5 | 6.76 | 7.46 | 8.02 | -0.63 |
| N203D/R355Q/K392N/Q419E/K447_ | 5 | 6.76 | 7.46 | 8.02 | -0.63 |
| K274Q/R355Q/K392N/Q419E/K447_ | 5 | 6.76 | 7.46 | 8.02 | -0.63 |

Figure 18B

| Variant | # of sub(s) | pI/pI | pI/WT | WT/WT | avg delta pI |
|---|---|---|---|---|---|
| G137E/N203D/K274Q/R355Q | 4 | 7.00 | 7.61 | 8.02 | -0.51 |
| G137E/N203D/K274Q/K392N | 4 | 7.00 | 7.61 | 8.02 | -0.51 |
| G137E/N203D/K274Q/Q419E | 4 | 7.00 | 7.61 | 8.02 | -0.51 |
| G137E/N203D/K274Q/K447 | 4 | 7.00 | 7.61 | 8.02 | -0.51 |
| G137E/N203D/R355Q/K392N | 4 | 7.00 | 7.61 | 8.02 | -0.51 |
| G137E/N203D/R355Q/Q419E | 4 | 7.00 | 7.61 | 8.02 | -0.51 |
| G137E/N203D/R355Q/K447 | 4 | 7.00 | 7.61 | 8.02 | -0.51 |
| G137E/N203D/K392N/Q419E | 4 | 7.00 | 7.61 | 8.02 | -0.51 |
| G137E/N203D/K392N/K447 | 4 | 7.00 | 7.61 | 8.02 | -0.51 |
| G137E/N203D/Q419E/K447 | 4 | 7.00 | 7.61 | 8.02 | -0.51 |
| G137E/K274Q/R355Q/K392N | 4 | 7.00 | 7.61 | 8.02 | -0.51 |
| G137E/K274Q/R355Q/Q419E | 4 | 7.00 | 7.61 | 8.02 | -0.51 |
| G137E/K274Q/R355Q/K447 | 4 | 7.00 | 7.61 | 8.02 | -0.51 |
| G137E/K274Q/K392N/Q419E | 4 | 7.00 | 7.61 | 8.02 | -0.51 |
| G137E/K274Q/K392N/K447 | 4 | 7.00 | 7.61 | 8.02 | -0.51 |
| G137E/K274Q/Q419E/K447 | 4 | 7.00 | 7.61 | 8.02 | -0.51 |
| G137E/R355Q/K392N/Q419E | 4 | 7.00 | 7.61 | 8.02 | -0.51 |
| G137E/R355Q/K392N/K447 | 4 | 7.00 | 7.61 | 8.02 | -0.51 |
| G137E/R355Q/Q419E/K447 | 4 | 7.00 | 7.61 | 8.02 | -0.51 |
| G137E/K392N/Q419E/K447 | 4 | 7.00 | 7.61 | 8.02 | -0.51 |
| N203D/K274Q/R355Q/K392N | 4 | 7.00 | 7.61 | 8.02 | -0.51 |
| N203D/K274Q/R355Q/Q419E | 4 | 7.00 | 7.61 | 8.02 | -0.51 |
| N203D/K274Q/R355Q/K447 | 4 | 7.00 | 7.61 | 8.02 | -0.51 |
| N203D/K274Q/K392N/Q419E | 4 | 7.00 | 7.61 | 8.02 | -0.51 |
| N203D/K274Q/K392N/K447 | 4 | 7.00 | 7.61 | 8.02 | -0.51 |
| N203D/K274Q/Q419E/K447 | 4 | 7.00 | 7.61 | 8.02 | -0.51 |
| N203D/R355Q/K392N/Q419E | 4 | 7.00 | 7.61 | 8.02 | -0.51 |
| N203D/R355Q/K392N/K447 | 4 | 7.00 | 7.61 | 8.02 | -0.51 |
| N203D/R355Q/Q419E/K447 | 4 | 7.00 | 7.61 | 8.02 | -0.51 |
| N203D/K392N/Q419E/K447 | 4 | 7.00 | 7.61 | 8.02 | -0.51 |

Figure 18C

| Variant | # of sub(s) | pI/pI | pI/WT | WT/WT | avg delta pI |
|---|---|---|---|---|---|
| K274Q/R355Q/K392N/Q419E | 4 | 7.00 | 7.61 | 8.02 | -0.51 |
| K274Q/R355Q/K392N/K447_ | 4 | 7.00 | 7.61 | 8.02 | -0.51 |
| K274Q/R355Q/Q419E/K447_ | 4 | 7.00 | 7.61 | 8.02 | -0.51 |
| K274Q/K392N/Q419E/K447_ | 4 | 7.00 | 7.61 | 8.02 | -0.51 |
| R355Q/K392N/Q419E/K447_ | 4 | 7.00 | 7.61 | 8.02 | -0.51 |
| G137E/N203D/K274Q | 3 | 7.30 | 7.74 | 8.02 | -0.36 |
| G137E/N203D/R355Q | 3 | 7.30 | 7.74 | 8.02 | -0.36 |
| G137E/N203D/K392N | 3 | 7.30 | 7.74 | 8.02 | -0.36 |
| G137E/N203D/Q419E | 3 | 7.30 | 7.74 | 8.02 | -0.36 |
| G137E/N203D/K447_ | 3 | 7.30 | 7.74 | 8.02 | -0.36 |
| G137E/K274Q/R355Q | 3 | 7.30 | 7.74 | 8.02 | -0.36 |
| G137E/K274Q/K392N | 3 | 7.30 | 7.74 | 8.02 | -0.36 |
| G137E/K274Q/Q419E | 3 | 7.30 | 7.74 | 8.02 | -0.36 |
| G137E/K274Q/K447_ | 3 | 7.30 | 7.74 | 8.02 | -0.36 |
| G137E/R355Q/K392N | 3 | 7.30 | 7.74 | 8.02 | -0.36 |
| G137E/R355Q/Q419E | 3 | 7.30 | 7.74 | 8.02 | -0.36 |
| G137E/R355Q/K447_ | 3 | 7.30 | 7.74 | 8.02 | -0.36 |
| G137E/K392N/Q419E | 3 | 7.30 | 7.74 | 8.02 | -0.36 |
| G137E/K392N/K447_ | 3 | 7.30 | 7.74 | 8.02 | -0.36 |
| G137E/Q419E/K447_ | 3 | 7.30 | 7.74 | 8.02 | -0.36 |
| N203D/K274Q/R355Q | 3 | 7.30 | 7.74 | 8.02 | -0.36 |
| N203D/K274Q/K392N | 3 | 7.30 | 7.74 | 8.02 | -0.36 |
| N203D/K274Q/Q419E | 3 | 7.30 | 7.74 | 8.02 | -0.36 |
| N203D/K274Q/K447_ | 3 | 7.30 | 7.74 | 8.02 | -0.36 |
| N203D/R355Q/K392N | 3 | 7.30 | 7.74 | 8.02 | -0.36 |
| N203D/R355Q/Q419E | 3 | 7.30 | 7.74 | 8.02 | -0.36 |
| N203D/R355Q/K447_ | 3 | 7.30 | 7.74 | 8.02 | -0.36 |
| N203D/K392N/Q419E | 3 | 7.30 | 7.74 | 8.02 | -0.36 |
| N203D/K392N/K447_ | 3 | 7.30 | 7.74 | 8.02 | -0.36 |
| N203D/Q419E/K447_ | 3 | 7.30 | 7.74 | 8.02 | -0.36 |

Figure 19

| Variant | # of sub(s) | pI/pI | pI/WT | WT/WT | avg delta pI |
|---|---|---|---|---|---|
| Q196K/P217R/P228R/N276K/H435R | 5 | 8.53 | 8.32 | 8.02 | 0.25 |
| Q196K/P217R/P228R/N276K | 4 | 8.45 | 8.27 | 8.02 | 0.22 |
| Q196K/P217R/P228R/H435R | 4 | 8.46 | 8.28 | 8.02 | 0.22 |
| Q196K/P217R/N276K/H435R | 4 | 8.45 | 8.27 | 8.02 | 0.22 |
| Q196K/P228R/N276K/H435R | 4 | 8.45 | 8.27 | 8.02 | 0.22 |
| P217R/P228R/N276K/H435R | 4 | 8.46 | 8.28 | 8.02 | 0.22 |
| Q196K/P217R/P228R | 3 | 8.37 | 8.22 | 8.02 | 0.17 |
| Q196K/P217R/N276K | 3 | 8.37 | 8.22 | 8.02 | 0.17 |
| Q196K/P217R/H435R | 3 | 8.37 | 8.22 | 8.02 | 0.17 |
| Q196K/P228R/N276K | 3 | 8.37 | 8.22 | 8.02 | 0.17 |
| Q196K/P228R/H435R | 3 | 8.37 | 8.22 | 8.02 | 0.17 |
| Q196K/N276K/H435R | 3 | 8.37 | 8.22 | 8.02 | 0.17 |
| P217R/P228R/N276K | 3 | 8.37 | 8.22 | 8.02 | 0.17 |
| P217R/P228R/H435R | 3 | 8.37 | 8.22 | 8.02 | 0.18 |
| P217R/N276K/H435R | 3 | 8.37 | 8.22 | 8.02 | 0.17 |
| P228R/N276K/H435R | 3 | 8.37 | 8.22 | 8.02 | 0.17 |
| Q196K/P217R | 2 | 8.27 | 8.16 | 8.02 | 0.13 |
| Q196K/P228R | 2 | 8.27 | 8.16 | 8.02 | 0.13 |
| Q196K/N276K | 2 | 8.27 | 8.16 | 8.02 | 0.13 |
| Q196K/H435R | 2 | 8.27 | 8.16 | 8.02 | 0.13 |
| P217R/P228R | 2 | 8.28 | 8.16 | 8.02 | 0.13 |
| P217R/N276K | 2 | 8.27 | 8.16 | 8.02 | 0.13 |
| P217R/H435R | 2 | 8.28 | 8.16 | 8.02 | 0.13 |
| P228R/N276K | 2 | 8.27 | 8.16 | 8.02 | 0.13 |
| P228R/H435R | 2 | 8.28 | 8.16 | 8.02 | 0.13 |
| N276K/H435R | 2 | 8.27 | 8.16 | 8.02 | 0.13 |
| Q196K | 1 | 8.16 | 8.10 | 8.02 | 0.07 |
| P217R | 1 | 8.16 | 8.10 | 8.02 | 0.07 |
| P228R | 1 | 8.16 | 8.10 | 8.02 | 0.07 |
| N276K | 1 | 8.16 | 8.10 | 8.02 | 0.07 |
| H435R | 1 | 8.16 | 8.10 | 8.02 | 0.07 |

Figure 20

Positive charged scFv linkers

| Name | Sequence | Length | Charge | SEQ ID NO: |
|---|---|---|---|---|
| Gly-Ser 15 | GGGGSGGGGSGGGGS | 15 | 0 | 429 |
| Whitlow linker | GSTSGSGKPGSGEGSTKG | 18 | +1 | 431 |
| 6paxA_1 (+A) | IRPRAIGGSKPRVA | 14 | +4 | 441 |
| +B | GKGGSGKGGSGKGGS | 15 | +3 | 442 |
| +C | GGKGSGGKGSGGKGS | 15 | +3 | 443 |
| +D | GGGKSGGGKSGGGKS | 15 | +3 | 444 |
| +E | GKGKSGKGKSGKGKS | 15 | +6 | 445 |
| +F | GGGKSGGKGSGKGGS | 15 | +3 | 446 |
| +G | GKPGSGKPGSGKPGS | 15 | +3 | 447 |
| +H | GKPGSGKPGSGKPGSGKPGS | 20 | +4 | 448 |
| +I | GKGKSGKGKSGKGKSGKGKS | 20 | +8 | 449 |

Negative charged scFv linkers

| Name | Sequence | Length | Charge | |
|---|---|---|---|---|
| Gly-Ser 15 | GGGGSGGGGSGGGGSGGGGS | 20 | 0 | 450 |
| 3hsc_2 (-A) | STAGDTHLGGEDFD | 14 | -4 | 451 |
| -B | GEGGSGEGGSGEGGS | 15 | -3 | 452 |
| -C | GGEGSGGEGSGGEGS | 15 | -3 | 453 |
| -D | GGGESGGGESGGGES | 15 | -3 | 454 |
| -E | GEGESGEGESGEGES | 15 | -6 | 455 |
| -F | GGGESGGEGSGEGGS | 15 | -3 | 456 |
| -G | GEGESGEGESGEGESGEGES | 20 | -8 | 457 |

Figure 21A

HETERODIMERIZATION VARIANTS

|  | IgG1 | IgG2 | IgG3 | IgG4 | Variants |
|---|---|---|---|---|---|
| 196 | Q | Q | Q | K | K |
| 199 | I | T | T | T | T |
| 203 | N | D | N | D | D |
| 217 | P | R | L | S | R |
| 220 | C | C | P | G | E,R (IgG2) |
| 221 | D |  | LGD |  | E,R (IgG1) |
| 222 | K | V | T |  | E,R (IgG2) |
| 223 | T |  | T |  | D,E,R,K |
| 225 | T |  | T | P | D,E,R,K |
| 228 | P | P | RCPEPK SCDTPP PCPRCP EPKSCD TPPPCP RCPEPK SCDTPP PCPR | S | D,E,R,K |
| 247 | P | P | P | P | Q |
| 276 | N | N | K | N | K |
| 340 | K | K | K | K | E,Q |
| 345 | E | E | E | E | K |
|  | Q | Q | Q | Q | E,K,R |
| 349 | Y | Y | Y | Y | A,C,D,E,I,K,S,T,W |
| 350 | T | T | T | T | I |
| 351 | L | L | L | L | E,K,V,Y |
| 354 | S | S | S | S | C |
| 355 | R | R | R | Q | E,Q |
| 356 | D | E | E | E | K, L, R |
| 357 | E | E | E | E | K,R,Q,T |
|  | K | K | K | K | D,E |
| 362 | Q | Q | Q | Q | E,K |
|  | S | S | S | S | C,D,E,F,G,H,K,R,T,Y |
| 366 | T | T | T | T | A,D,I,K,L,M,S,V,W,Y |
|  | L | L | L | L | A,D,E,K,S all but C,P |
| 370 | K | K | K | K | C,D,E,G,R,S,T,V all but C,P |
| 371 | G | G | G | G | D |
| 384 | N | N | S | N | S |
| 390 | N | N | N | N | D,E,K,R |
| 392 | K | K | N | K | C,D,E,F,L,M,N |

Figure 21B

|     | IgG1 | IgG2 | IgG3 | IgG4 | Variants |
|-----|------|------|------|------|----------|
| 394 | T | T | T | T | F,S,V,W,Y |
| 395 | P | P | P | P | T,V |
| 396 | P | P | P | P | T,V |
| 397 | V | M | M | V | M,S,T |
| 399 | D | D | D | D | all but C,P<br>C,K,R |
| 400 | S | S | S | S | A,D,E,K,R |
| 401 | D | D | D | D | K,N,R |
| 405 | F | F | F | F | L, all but C,P<br>A,F,L,M,S,T,V |
| 407 | Y | Y | Y | Y | T,V<br>all but C,P<br>A,L,M,V |
| 409 | K | K | K | R | R<br>,all but C,P<br>D,E,F,K,L,M,V,W |
|     | T | T | T | T | D,E,K,L,N,R,S |
| 419 | Q | Q | Q | E | E |
| 439 | K | K | K | K | D,E |

| Variant | Tm |
|---|---|
| VH CDR1: N30S (XENP11803, H1.8 L1.4) | $\Delta T_m = +1.50$ |
| VH Frwk: Q39K (XENP12138, H1.37 L1.4) | $\Delta T_m = +2.25$ |
| VH CDR3: N100D (XENP11819, H1.24 L1.4) | $\Delta T_m = +0.50$ |
| VL Frwk: Q42K (XENP12108, H1 L1.33) | $\Delta T_m = +0.50$ |
| VL Frwk: A43S (XENP12113, H1 L1.38) | $\Delta T_m = +0.50$ |
| VL Frwk: L75I (XENP11838, H1 L1.23) | $\Delta T_m = +0.75$ |
| VL Frwk: E85D (XENP11841, H1 L1.26) | $\Delta T_m = +1.25$ |
| VL CDR3: L95H (XENP11843, H1 L1.28) | $\Delta T_m = +0.25$ |

Figure 23A

| Monomer 1 | Monomer 2 |
|---|---|
| ISO(-) side | ISO(+RR) side |
| T411E | D401K |
| T411E K360D | D401K |
| T411E K360E | D401K |
| T411E Q362E | D401K |
| T411E N390D | D401K |
| T411E | D401K Q347K |
| T411E | D401K Q347R |
| T411E K360D Q362E | D401K |
| T411E K360E Q362E | D401K |
| T411E K360E N390D | D401K |
| T411E Q362E N390D | D401K |
| T411E Q347R | D401K K360D |
| T411E Q347R | D401K K360E |
| T411E K360D | D401K Q347K |
| T411E K360D | D401K Q347R |
| T411E K360E | D401K Q347K |
| T411E K360E | D401K Q347R |
| T411E S364K | D401K K370S |
| T411E K370S | D401K S364K |
| Q347E | E357Q |
| Q347E | E357Q Q362K |

Figure 23B

| Monomer 1 | Monomer 2 |
|---|---|
| K360D Q362E | Q347R |
| K360D Q362E | D401K |
| K360D Q362E | Q347R D401K |
| K360E Q362E | Q347R |
| K360E Q362E | D401K |
| K360E Q362E | Q347R D401K |
| Q362E N390D | D401K |
| Q347E K360D | D401N |
| K360D | Q347R N390K |
| K360D | N390K D401N |
| K360E | Y349H |
| K370S Q347E | S364K |
| K370S E357L | S364K |
| K370S E357Q | S364K |
| K370S Q347E E357L | S364K |
| K370S Q347E E357Q | S364K |
| L368D K370S Q347E | S364K |
| L368D K370S E357L | S364K |
| L368D K370S E357Q | S364K |
| L368D K370S Q347E E357L | S364K |
| L368D K370S Q347E E357Q | S364K |
| L368E K370S Q347E | S364K |
| L368E K370S E357L | S364K |
| L368E K370S E357Q | S364K |
| L368E K370S Q347E E357L | S364K |
| L368E K370S Q347E E357Q | S364K |

Figure 23C

| Monomer 1 | Monomer 2 |
|---|---|
| L368D K370T Q347E | S364K |
| L368D K370T E357L | S364K |
| L368D K370T E357Q | S364K |
| L368D K370T Q347E E357L | S364K |
| L368D K370T Q347E E357Q | S364K |
| L368E K370T Q347E | S364K |
| L368E K370T E357L | S364K |
| L368E K370T E357Q | S364K |
| L368E K370T Q347E E357L | S364K |
| L368E K370T Q347E E357Q | S364K |
| T411E Q362E | D401K T411K |
| T411E N390D | D401K T411K |
| T411E Q362E | D401R T411R |
| T411E N390D | D401R T411R |

Figure 24A

Stabilized anti-CD19 variable regions

Melting temperatures ($T_m$) were determined by DSF at concentrations of 0.2 mg/mL.

| Variant | Substitutions | $T_m$ | $\Delta T_m$ |
|---|---|---|---|
| 4G7_H1.52_L1.155_scFv_6X-His | Control standard scFv (VH-VL) | 58.5 | |
| 4G7_L1.155_H1.52_scFv_6X-His | reversed orientation (VL-VH) | 61.5 | 3.0 |
| 4G7_H1.211_L1.155_scFv_6X-His | VH-Q64K | 59.5 | 1.0 |
| 4G7_H1.212_L1.155_scFv_6X-His | VH-S71R | 55.0 | -3.5 |
| 4G7_H1.213_L1.155_scFv_6X-His | VH-I75K | 59.0 | 0.5 |
| 4G7_H1.214_L1.155_scFv_6X-His | VH-I75T | 58.5 | 0.0 |
| 4G7_H1.215_L1.155_scFv_6X-His | VH-S71R + VH-I75K | 56.0 | -2.5 |
| 4G7_H1.216_L1.155_scFv_6X-His | VH-E81Q | 58.5 | 0.0 |
| 4G7_H1.217_L1.155_scFv_6X-His | VH-E81K | 58.0 | -0.5 |
| 4G7_H1.218_L1.155_scFv_6X-His | VH-M89V | 59.0 | 0.5 |
| 4G7_H1.219_L1.155_scFv_6X-His | VH-D55G | 57.0 | -1.5 |
| 4G7_H1.221_L1.155_scFv_6X-His | VH-L82M | 58.5 | 0.0 |
| 4G7_H1.222_L1.155_scFv_6X-His | VH-V33G | 49.5 | -9.0 |
| 4G7_H1.223_L1.155_scFv_6X-His | VH-K43G | 59.5 | 1.0 |
| 4G7_H1.225_L1.197_scFv_6X-His | VH-Q105C + VL-S43C | 51.5 | -7.0 |
| 4G7_H1.52_L1.176_scFv_6X-His | VL-T10S | 58.0 | -0.5 |
| 4G7_H1.52_L1.177_scFv_6X-His | VL-L13V | 58.5 | 0.0 |
| 4G7_H1.52_L1.178_scFv_6X-His | VL-L21I | 59.5 | 1.0 |
| 4G7_H1.52_L1.179_scFv_6X-His | VL-K27Q | 51.0 | -7.5 |
| 4G7_H1.52_L1.180_scFv_6X-His | VL-Y34A | 63.0 | 4.5 |
| 4G7_H1.52_L1.181_scFv_6X-His | VL-Y34S | 63.5 | 5.0 |
| 4G7_H1.52_L1.182_scFv_6X-His | VL-Y34N | 61.5 | 3.0 |
| 4G7_H1.52_L1.183_scFv_6X-His | VL-Y34D | 61.0 | 2.5 |
| 4G7_H1.52_L1.184_scFv_6X-His | VL-F36Y | 59.0 | 0.5 |
| 4G7_H1.52_L1.185_scFv_6X-His | VL-Q45K | 60.0 | 1.5 |
| 4G7_H1.52_L1.186_scFv_6X-His | VL-M51A | 59.5 | 1.0 |
| 4G7_H1.52_L1.187_scFv_6X-His | VL-N55Q | 57.5 | -1.0 |
| 4G7_H1.52_L1.188_scFv_6X-His | VL-N55E | 58.5 | 0.0 |
| 4G7_H1.52_L1.190_scFv_6X-His | VL-N55D | 59.0 | 0.5 |
| 4G7_H1.52_L1.189_scFv_6X-His | VL-N55F | 58.0 | -0.5 |
| 4G7_H1.52_L1.191_scFv_6X-His | VL-N55A | 59.5 | 1.0 |
| 4G7_H1.52_L1.192_scFv_6X-His | VL-E70D | 58.5 | 0.0 |
| 4G7_H1.52_L1.194_scFv_6X-His | VL-A100Q | 59.5 | 1.0 |
| 4G7_H1.52_L1.195_scFv_6X-His | VL-A100G | 59.5 | 1.0 |
| 4G7_H1.52_alternate_linker_L1.155_scFv_6X-His | VEGGSGGSGGSGGSGGVD linker | 59.0 | 0.5 |

≈ SEQ ID NO: 729

Figure 24B

Stabilized anti-CD19 variable regions

Melting temperatures ($T_m$) were determined by DSF at concentrations of 0.4 mg/mL.

| Variant | Substitutions | $T_m$ | $\Delta T_m$ |
|---|---|---|---|
| 4G7_H1.226_L1.198_20AA_linker_scFv_6X-His | VH-K43G/Q64K + VL-L21I/Q45K/A100G + 20AA linker | 63.5 | +5.0 |
| 4G7_H1.227_L1.198_20AA_linker_scFv_6X-His | VH-K43G/Q64K/I75K/M89V + VL-L21I/Q45K/A100G + 20AA linker | 64 | +5.5 |
| 4G7_L1.155_H1.52_20AA_linker_scFv_6X-His | Rvs. orientation and 20AA linker | 61 | +2.5 |
| 4G7_L1.198_H1.226_20AA_linker_scFv_6X-His | VH-K43G/Q64K + VL-L21I/Q45K/A100G + 20AA linker and rvs. orient. | 66 | +7.5 |
| 4G7_L1.198_H1.227_20AA_linker_scFv_6X-His | VH-K43G/Q64K/I75K/M89V + VL-L21I/Q45K/A100G + 20AA linker and rvs. orient. | 67 | +8.5 |
| 4G7_L1.199_H1.227_20AA_linker_scFv_6X-His | VH-K43G/Q64K/I75K/M89V + VL-L21I/Q45K/M51A/A100G + 20AA linker and rvs. orient. | 68 | +9.5 |
| 4G7_L1.200_H1.227_20AA_linker_scFv_6X-His | VH-K43G/Q64K/I75K/M89V + VL-L21I/Y34S/Q45K/A100G + 20AA linker and rvs. orient. | 72 | +13.5 |

Figure 25A
Stabilized anti-CD19 scFv variants

4G7_H1.52_L1.155_scFv_6X-His    SEQ ID NO: 458

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.52_L1.155_scFv_no His    SEQ ID NO: 459

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_L1.155_H1.52_scFv_6X-His    SEQ ID NO: 460

DIVMTQSPATLSLSPGERATLSCRSSKSLQNVNGNTYLYWFQQKPGQSPQLLIYRMSNLNSGVPDRFSGSGSGTEFTLTISSLEPEDF
AVYYCMQHLEYPITFGAGTKLEIKGGGGSGGGGSGGGGSEVQLVESGGGLVKPGGSLKLSCAASGYTFTSYVMHWVRQAPGKGLE
WIGYINPYNDGTKYNEKFQGRVTISSDKSISTAYMELSSLRSEDTAMYYCARGTYYYGTRVFDYWGQGTLVTVSSGSHHHHHH

4G7_L1.155_H1.52_scFv_no His    SEQ ID NO: 461

DIVMTQSPATLSLSPGERATLSCRSSKSLQNVNGNTYLYWFQQKPGQSPQLLIYRMSNLNSGVPDRFSGSGSGTEFTLTISSLEPEDF
AVYYCMQHLEYPITFGAGTKLEIKGGGGSGGGGSGGGGSEVQLVESGGGLVKPGGSLKLSCAASGYTFTSYVMHWVRQAPGKGLE
WIGYINPYNDGTKYNEKFQGRVTISSDKSISTAYMELSSLRSEDTAMYYCARGTYYYGTRVFDYWGQGTLVTVSS

4G7_H1.211_L1.155_scFv_6X-His SEQ ID NO: 462

EVQLVESGGGLVKPGGSLKLSCAASGYTFTSYVMHWVRQAPGKGLEWIGYINPYNDGTKYNEKFKGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.211_L1.155_scFv_no His SEQ ID NO: 463

EVQLVESGGGLVKPGGSLKLSCAASGYTFTSYVMHWVRQAPGKGLEWIGYINPYNDGTKYNEKFKGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.212_L1.155_scFv_6X-His SEQ ID NO: 464

EVQLVESGGGLVKPGGSLKLSCAASGYTFTSYVMHWVRQAPGKGLEWIGYINPYNDGTKYNEKFQGRVTISRDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.212_L1.155_scFv_no His SEQ ID NO: 465

EVQLVESGGGLVKPGGSLKLSCAASGYTFTSYVMHWVRQAPGKGLEWIGYINPYNDGTKYNEKFQGRVTISRDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.213_L1.155_scFv_6X-His SEQ ID NO: 466

Figure 25B

EVQLVESGGGLVKPGGSLKLSCAASGYTFT<u>SYVMH</u>WVRQAPGKGLEWIG<u>YINPYNDGTKYNEKFQG</u>RVTISSDKSKSTAYMELSSLR
SEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

<u>4G7 H1.213 L1.155 scFv no His</u> SEQ ID NO: 467

EVQLVESGGGLVKPGGSLKLSCAASGYTFT<u>SYVMH</u>WVRQAPGKGLEWIG<u>YINPYNDGTKYNEKFQG</u>RVTISSDKSKSTAYMELSSLR
SEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

<u>4G7 H1.214 L1.155 scFv 6X-His</u> SEQ ID NO: 468

EVQLVESGGGLVKPGGSLKLSCAASGYTFT<u>SYVMH</u>WVRQAPGKGLEWIG<u>YINPYNDGTKYNEKFQG</u>RVTISSDKSTSTAYMELSSLR
SEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

<u>4G7 H1.214 L1.155 scFv no His</u> SEQ ID NO: 469

EVQLVESGGGLVKPGGSLKLSCAASGYTFT<u>SYVMH</u>WVRQAPGKGLEWIG<u>YINPYNDGTKYNEKFQG</u>RVTISSDKSTSTAYMELSSLR
SEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

<u>4G7 H1.215 L1.155 scFv 6X-His</u> SEQ ID NO: 470

EVQLVESGGGLVKPGGSLKLSCAASGYTFT<u>SYVMH</u>WVRQAPGKGLEWIG<u>YINPYNDGTKYNEKFQG</u>RVTISRDKSKSTAYMELSSL
RSEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNG
NTYLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

<u>4G7 H1.215 L1.155 scFv no His</u> SEQ ID NO: 471

EVQLVESGGGLVKPGGSLKLSCAASGYTFT<u>SYVMH</u>WVRQAPGKGLEWIG<u>YINPYNDGTKYNEKFQG</u>RVTISRDKSKSTAYMELSSL
RSEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNG
NTYLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

<u>4G7 H1.216 L1.155 scFv 6X-His</u> SEQ ID NO: 472

EVQLVESGGGLVKPGGSLKLSCAASGYTFT<u>SYVMH</u>WVRQAPGKGLEWIG<u>YINPYNDGTKYNEKFQG</u>RVTISSDKSISTAYMQLSSLR
SEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

<u>4G7 H1.216 L1.155 scFv no His</u> SEQ ID NO: 473

EVQLVESGGGLVKPGGSLKLSCAASGYTFT<u>SYVMH</u>WVRQAPGKGLEWIG<u>YINPYNDGTKYNEKFQG</u>RVTISSDKSISTAYMQLSSLR
SEDTAMYYCAR<u>GTYYYGTRVFDY</u>WGQGTLVTVSS<u>GGGGSGGGGSGGGGS</u>DIVMTQSPATLSLSPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

Figure 25C

4G7_H1.217_L1.155_scFv_6X-His SEQ ID NO: 474

EVQLVESGGGLVKPGGSLKLSCAASGYTFTSYVMHWVRQAPGKGLEWIGYINPYNDGTKYNEKFQGRVTISSDKSISTAYMKLSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.217_L1.155_scFv no His SEQ ID NO: 475

EVQLVESGGGLVKPGGSLKLSCAASGYTFTSYVMHWVRQAPGKGLEWIGYINPYNDGTKYNEKFQGRVTISSDKSISTAYMKLSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.218_L1.155_scFv_6X-His SEQ ID NO: 476

EVQLVESGGGLVKPGGSLKLSCAASGYTFTSYVMHWVRQAPGKGLEWIGYINPYNDGTKYNEKFQGRVTISSDKSISTAYMELSSLR
SEDTAVYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.218_L1.155_scFv_no His SEQ ID NO: 477

EVQLVESGGGLVKPGGSLKLSCAASGYTFTSYVMHWVRQAPGKGLEWIGYINPYNDGTKYNEKFQGRVTISSDKSISTAYMELSSLR
SEDTAVYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.219_L1.155_scFv_6X-His SEQ ID NO: 725

EVQLVESGGGLVKPGGSLKLSCAASGYTFTSYVMHWVRQAPGKGLEWIGYINPYNGGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.219_L1.155_scFv_no His SEQ ID NO: 726

EVQLVESGGGLVKPGGSLKLSCAASGYTFTSYVMHWVRQAPGKGLEWIGYINPYNGGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.221_L1.155_scFv_6X-His SEQ ID NO: 727

EVQLVESGGGLVKPGGSLKLSCAASGYTFTSYVMHWVRQAPGKGLEWIGYINPYNDGTKYNEKFQGRVTISSDKSISTAYMEMSSL
RSEDTAMYYCARGTYYYGTRVFDYWGQGTLVTVSSGGGGSGGGGSGGGGSDIVMTQSPATLSLSPGERATLSCRSSKSLQNVNG
NTYLYWFQQKPGQSPQLLIYRMSNLNSGVPDRFSGSGSGTEFTLTISSLEPEDFAVYYCMQHLEYPITFGAGTKLEIKGSHHHHHH

4G7_H1.221_L1.155_scFv_no His SEQ ID NO: 481

EVQLVESGGGLVKPGGSLKLSCAASGYTFTSYVMHWVRQAPGKGLEWIGYINPYNDGTKYNEKFQGRVTISSDKSISTAYMEMSSL
RSEDTAMYYCARGTYYYGTRVFDYWGQGTLVTVSSGGGGSGGGGSGGGGSDIVMTQSPATLSLSPGERATLSCRSSKSLQNVNG
NTYLYWFQQKPGQSPQLLIYRMSNLNSGVPDRFSGSGSGTEFTLTISSLEPEDFAVYYCMQHLEYPITFGAGTKLEIK

Figure 25D

4G7_H1.222_L1.155_scFv_6X-His SEQ ID NO: 728

EVQLVESGGGLVKPGGSLKLSCAASGYTFTSYGMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.222_L1.155_scFv_no His SEQ ID NO: 483

EVQLVESGGGLVKPGGSLKLSCAASGYTFTSYGMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.223_L1.155_scFv_6X-His SEQ ID NO: 484

EVQLVESGGGLVKPGGSLKLSCAASGYTFTSYVMHWVRQAPGGGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.223_L1.155_scFv_no His SEQ ID NO: 485

EVQLVESGGGLVKPGGSLKLSCAASGYTFTSYVMHWVRQAPGGGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

4G7_H1.225_L1.197_scFv_6X-His SEQ ID NO: 486

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGCGTLVTVSSGGGGSGGGGSGGGGSDIVMTQSPATLSLSPGERATLSCRSSKSLQNVNGNT
YLYWFQQKPGQCPQLLIYRMSNLNSGVPDRFSGSGSGTEFTLTISSLEPEDFAVYYCMQHLEYPITFGAGTKLEIKGSHHHHHH

4G7_H1.225_L1.197_scFv_no His SEQ ID NO: 487

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGCGTLVTVSSGGGGSGGGGSGGGGSDIVMTQSPATLSLSPGERATLSCRSSKSLQNVNGNT
YLYWFQQKPGQCPQLLIYRMSNLNSGVPDRFSGSGSGTEFTLTISSLEPEDFAVYYCMQHLEYPITFGAGTKLEIK

4G7_H1.52_L1.176_scFv_6X-His SEQ ID NO: 488

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPASLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIKGSHHHHHH

4G7_H1.52_L1.176_scFv_no His SEQ ID NO: 489

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPASLSLSPGERATLSCRSSKSLQNVNGNT
YLYWFQQKPGQSPQLLIYRMSNLNSGVPDRFSGSGSGTEFTLTISSLEPEDFAVYYCMQHLEYPITFGAGTKLEIK

Figure 25E

4G7_H1.52_L1.177_scFv_6X-His SEQ ID NO: 490

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSVSPGERATLSC<u>RSSKSLQNVNGN</u>
<u>TYLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.177_scFv_no His SEQ ID NO: 491

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSVSPGERATLSC<u>RSSKSLQNVNGN</u>
<u>TYLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_H1.52_L1.178_scFv_6X-His SEQ ID NO: 492

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATISC<u>RSSKSLQNVNGNT</u>
<u>YLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.178_scFv_no His SEQ ID NO: 493

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATISC<u>RSSKSLQNVNGNT</u>
<u>YLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_H1.52_L1.179_scFv_6X-HisSEQ ID NO: 494

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSQSLQNVNGN</u>
<u>TYLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.179_scFv_no His SEQ ID NO: 495

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSQSLQNVNGN</u>
<u>TYLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_H1.52_L1.180_scFv_6X-His SEQ ID NO: 496

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSCRSSKSLQNVNGNT
YLAWFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.180_scFv_no His SEQ ID NO: 497

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLA</u>WFQQKPGQSPQLLIY<u>RMSNLNS</u>GVPDRFSGSGSGTEFTLTISSLEPEDFAVYYC<u>MQHLEYPIT</u>FGAGTKLEIK

Figure 25F

4G7_H1.52_L1.181_scFv_6X-His SEQ ID NO:498

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLS</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.181_scFv_no His SEQ ID NO: 499

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLS</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_H1.52_L1.182_scFv_6X-His SEQ ID NO: 500

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLN</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.182_scFv_no His SEQ ID NO: 501

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLN</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_H1.52_L1.183_scFv_6X-His SEQ ID NO: 502

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLD</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.183_scFv_no His SEQ ID NO: 503

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSC<u>RSSKSLQNVNGNT</u>
<u>YLD</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_H1.52_L1.184_scFv_6X-His SEQ ID NO: 504

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSCRSSKSLQNVNGNT
YLYWYQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_L1.184_scFv_no His SEQ ID NO: 505

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLSPGERATLSCRSSKSLQNVNGNT
YLYWYQQKPGQSPQLLIY<u>RMSNLNS</u>GVPDRFSGSGSGTEFTLTISSLEPEDFAVYYC<u>MQHLEYPIT</u>FGAGTKLEIK

Figure 25G

4G7_H1.52_L1.185_scFv_6X-His SEQ ID NO: 506

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPKLLIYRMSNLNSGVPDRFSGSGSGTEFTLTISSLEPEDFAVYYCMQHLEYPITFGAGTKLEIKGSHHHHHH

4G7_H1.52_L1.185_scFv_no His SEQ ID NO: 507

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPKLLIYRMSNLNSGVPDRFSGSGSGTEFTLTISSLEPEDFAVYYCMQHLEYPITFGAGTKLEIK

4G7_H1.52_L1.186_scFv_6X-His SEQ ID NO: 508

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRASNLNSGVPDRFSGSGSGTEFTLTISSLEPEDFAVYYCMQHLEYPITFGAGTKLEIKGSHHHHHH

4G7_H1.52_L1.186_scFv_no His SEQ ID NO: 509

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRASNLNSGVPDRFSGSGSGTEFTLTISSLEPEDFAVYYCMQHLEYPITFGAGTKLEIK

4G7_H1.52_L1.187_scFv_6X-His SEQ ID NO: 510

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLQSGVPDRFSGSGSGTEFTLTISSLEPEDFAVYYCMQHLEYPITFGAGTKLEIKGSHHHHHH

4G7_H1.52_L1.187_scFv_no His SEQ ID NO: 511

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLQSGVPDRFSGSGSGTEFTLTISSLEPEDFAVYYCMQHLEYPITFGAGTKLEIK

4G7_H1.52_L1.188_scFv_6X-His SEQ ID NO: 512

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLESGVPDRFSGSGSGTEFTLTISSLEPEDFAVYYCMQHLEYPITFGAGTKLEIKGSHHHHHH

4G7_H1.52_L1.188_scFv_no His SEQ ID NO: 513

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLESGVPDRFSGSGSGTEFTLTISSLEPEDFAVYYCMQHLEYPITFGAGTKLEIK

Figure 25H

4G7_H1.52_L1.189_scFv_6X-His SEQ ID NO: 514

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLFSGVPDRFSGSGSGTEFTLTISSLEPEDFAVYYCMQHLEYPITFGAGTKLEIKGSHHHHHH

4G7_H1.52_L1.189_scFv_no His SEQ ID NO: 515

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLFSGVPDRFSGSGSGTEFTLTISSLEPEDFAVYYCMQHLEYPITFGAGTKLEIK

4G7_H1.52_L1.190_scFv_6X-His SEQ ID NO: 516

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLDSGVPDRFSGSGSGTEFTLTISSLEPEDFAVYYCMQHLEYPITFGAGTKLEIKGSHHHHHH

4G7_H1.52_L1.190_scFv_no His SEQ ID NO: 517

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLDSGVPDRFSGSGSGTEFTLTISSLEPEDFAVYYCMQHLEYPITFGAGTKLEIK

4G7_H1.52_L1.191_scFv_6X-His SEQ ID NO: 518

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLASGVPDRFSGSGSGTEFTLTISSLEPEDFAVYYCMQHLEYPITFGAGTKLEIKGSHHHHHH

4G7_H1.52_L1.191_scFv_no His SEQ ID NO: 519

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLASGVPDRFSGSGSGTEFTLTISSLEPEDFAVYYCMQHLEYPITFGAGTKLEIK

4G7_H1.52_L1.192_scFv_6X-His SEQ ID NO: 520

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTDFTLTISSLEPEDFAVYYCMQHLEYPITFGAGTKLEIKGSHHHHHH

4G7_H1.52_L1.192_scFv_no His SEQ ID NO: 521

EVQLVESGGGLVKPGGSLKLSCAASGYTFTSYVMHWVRQAPGKGLEWIGYINPYNDGTKYNEKFQGRVTISSDKSISTAYMELSSLR
SEDTAMYYCARGTYYYGTRVFDYWGQGTLVTVSSGGGGSGGGGSGGGGSDIVMTQSPATLSLSPGERATLSCRSSKSLQNVNGNT
YLYWFQQKPGQSPQLLIYRMSNLNSGVPDRFSGSGSGTDFTLTISSLEPEDFAVYYCMQHLEYPITFGAGTKLEIK

Figure 25I

4G7_H1.52_L1.194_scFv_6X-His SEQ ID NO: 522

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGQGTKLEIKGSHHHHHH

4G7_H1.52_L1.194_scFv_no His SEQ ID NO: 523

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGQGTKLEIK

4G7_H1.52_L1.195_scFv_6X-His SEQ ID NO: 524

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGGGTKLEIKGSHHHHHH

4G7_H1.52_L1.195_scFv_no His SEQ ID NO: 525

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSGGGGSGGGGSGGGGSDIVMTQSPATLSLPGERATLSC<u>RSSKSLQNVNGNT
YLY</u>WFQQKPGQSPQLLIY<u>RMSNLNS</u>GVPDRFSGSGSGTEFTLTISSLEPEDFAVYYC<u>MQHLEYPIT</u>FGGGTKLEIK

4G7_H1.52_alternate_linker_L1.155_scFv_6X-His SEQ ID NO: 526

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSVEGGSGGSGGSGGSGGVDDIVMTQSPATLSLPGERATLSC<u>RSSKSLQNVN
GNTYLY</u>WFQQKPGQSPQLLIY<u>RMSNLNS</u>GVPDRFSGSGSGTEFTLTISSLEPEDFAVYYC<u>MQHLEYPIT</u>FGAGTKLEIKGSHHHHHH

4G7_H1.52_alternate_linker_L1.155_scFv_no His SEQ ID NO: 527

EVQLVESGGGLVKPGGSLKLSCAASGYTFT<u>SYVMH</u>WVRQAPGKGLEWIG<u>YINPYNDGTKYNEKFQG</u>RVTISSDKSISTAYMELSSLR
SEDTAMYYCAR<u>GTYYYGTRVFDY</u>WGQGTLVTVSSVEGGSGGSGGSGGSGGVDDIVMTQSPATLSLPGERATLSC<u>RSSKSLQNVN
GNTYLY</u>WFQQKPGQSPQLLIY<u>RMSNLNS</u>GVPDRFSGSGSGTEFTLTISSLEPEDFAVYYC<u>MQHLEYPIT</u>FGAGTKLEIK

4G7_L1.199_H1.227_20AA_linker_scFv_6X-His SEQ ID NO: 528

DIVMTQSPATLSLSPGERATISC<u>RSSKSLQNVNGNTYLY</u>WFQQKPGQSPKLLIY<u>RASNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSKSTAYMELSSLRSEDTAVYYCAR<u>GTYYYGTRVFDY</u>WGQGTLVTVSSSGHHHH
HH

4G7_L1.199_H1.227_20AA_linker_scFv_no His SEQ ID NO: 529

DIVMTQSPATLSLSPGERATISC<u>RSSKSLQNVNGNTYLY</u>WFQQKPGQSPKLLIY<u>RASNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSKSTAYMELSSLRSEDTAVYYCAR<u>GTYYYGTRVFDY</u>WGQGTLVTVSS

Figure 25J

4G7_H1.227_L1.198_20AA_linker_scFv_6X-His SEQ ID NO: 530

EVQLVESGGGLVKPGGSLKLSCAASGYTFTSYVMHWVRQAPGGGLEWIGYINPYNDGTKYNEKFKGRVTISSDKSKSTAYMELSSLR
SEDTAVYYCARGTYYYGTRVFDYWGQGTLVTVSSGGGGSGGGGSGGGGSGGGGSDIVMTQSPATLSLSPGERATISCRSSKSLQN
VNGNTYLYWFQQKPGQSPKLLIYRMSNLNSGVPDRFSGSGSGTEFTLTISSLEPEDFAVYYCMQHLEYPITFGGGTKLEIKGSHHHH
HH

4G7_H1.227_L1.198_20AA_linker_scFv_no His SEQ ID NO: 531

EVQLVESGGGLVKPGGSLKLSCAASGYTFTSYVMHWVRQAPGGGLEWIGYINPYNDGTKYNEKFKGRVTISSDKSKSTAYMELSSLR
SEDTAVYYCARGTYYYGTRVFDYWGQGTLVTVSSGGGGSGGGGSGGGGSGGGGSDIVMTQSPATLSLSPGERATISCRSSKSLQN
VNGNTYLYWFQQKPGQSPKLLIYRMSNLNSGVPDRFSGSGSGTEFTLTISSLEPEDFAVYYCMQHLEYPITFGGGTKLEIK

4G7_H1.226_L1.198_20AA_linker_scFv_6X-His SEQ ID NO: 532

EVQLVESGGGLVKPGGSLKLSCAASGYTFTSYVMHWVRQAPGGGLEWIGYINPYNDGTKYNEKFKGRVTISSDKSISTAYMELSSLR
SEDTAMYYCARGTYYYGTRVFDYWGQGTLVTVSSGGGGSGGGGSGGGGSGGGGSDIVMTQSPATLSLSPGERATISCRSSKSLQN
VNGNTYLYWFQQKPGQSPKLLIYRMSNLNSGVPDRFSGSGSGTEFTLTISSLEPEDFAVYYCMQHLEYPITFGGGTKLEIKGSHHHH
HH

4G7_H1.226_L1.198_20AA_linker_scFv_no His SEQ ID NO: 533

EVQLVESGGGLVKPGGSLKLSCAASGYTFTSYVMHWVRQAPGGGLEWIGYINPYNDGTKYNEKFKGRVTISSDKSISTAYMELSSLR
SEDTAMYYCARGTYYYGTRVFDYWGQGTLVTVSSGGGGSGGGGSGGGGSGGGGSDIVMTQSPATLSLSPGERATISCRSSKSLQN
VNGNTYLYWFQQKPGQSPKLLIYRMSNLNSGVPDRFSGSGSGTEFTLTISSLEPEDFAVYYCMQHLEYPITFGGGTKLEIK

4G7_L1.155_H1.52_20AA_linker_scFv_6X-His SEQ ID NO: 534

DIVMTQSPATLSLSPGERATLSCRSSKSLQNVNGNTYLYWFQQKPGQSPQLLIYRMSNLNSGVPDRFSGSGSGTEFTLTISSLEPEDF
AVYYCMQHLEYPITFGAGTKLEIKGGGGSGGGGSGGGGSGGGGSEVQLVESGGGLVKPGGSLKLSCAASGYTFTSYVMHWVRQA
PGKGLEWIGYINPYNDGTKYNEKFQGRVTISSDKSISTAYMELSSLRSEDTAMYYCARGTYYYGTRVFDYWGQGTLVTVSSGSHHHH
HH

4G7_L1.155_H1.52_20AA_linker_scFv_no His SEQ ID NO: 535

DIVMTQSPATLSLSPGERATLSCRSSKSLQNVNGNTYLYWFQQKPGQSPQLLIYRMSNLNSGVPDRFSGSGSGTEFTLTISSLEPEDF
AVYYCMQHLEYPITFGAGTKLEIKGGGGSGGGGSGGGGSGGGGSEVQLVESGGGLVKPGGSLKLSCAASGYTFTSYVMHWVRQA
PGKGLEWIGYINPYNDGTKYNEKFQGRVTISSDKSISTAYMELSSLRSEDTAMYYCARGTYYYGTRVFDYWGQGTLVTVSS

4G7_L1.198_H1.226_20AA_linker_scFv_6X-His SEQ ID NO: 536

DIVMTQSPATLSLSPGERATISCRSSKSLQNVNGNTYLYWFQQKPGQSPKLLIYRMSNLNSGVPDRFSGSGSGTEFTLTISSLEPEDFA
VYYCMQHLEYPITFGGGTKLEIKGGGGSGGGGSGGGGSGGGGSEVQLVESGGGLVKPGGSLKLSCAASGYTFTSYVMHWVRQAP
GGGLEWIGYINPYNDGTKYNEKFKGRVTISSDKSISTAYMELSSLRSEDTAMYYCARGTYYYGTRVFDYWGQGTLVTVSSGSHHHH
HH

Figure 25K

4G7_L1.198_H1.226_20AA_linker_scFv_no His SEQ ID NO: 537

DIVMTQSPATLSLSPGERATISC<u>RSSKSLQNVNGNTYLY</u>WFQQKPGQSPKLLIY<u>RMSNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSISTAYMELSSLRSEDTAMYYCAR<u>GTYYYGTRVFDY</u>WGQGTLVTVSS

4G7_L1.198_H1.227_20AA_linker_scFv_6X-His SEQ ID NO: 538

DIVMTQSPATLSLSPGERATISC<u>RSSKSLQNVNGNTYLY</u>WFQQKPGQSPKLLIY<u>RMSNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSKSTAYMELSSLRSEDTAVYYCAR<u>GTYYYGTRVFDY</u>WGQGTLVTVSSGSHHHH
HH

4G7_L1.198_H1.227_20AA_linker_scFv_no His SEQ ID NO: 539

DIVMTQSPATLSLSPGERATISC<u>RSSKSLQNVNGNTYLY</u>WFQQKPGQSPKLLIY<u>RMSNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSKSTAYMELSSLRSEDTAVYYCAR<u>GTYYYGTRVFDY</u>WGQGTLVTVSS

4G7_L1.200_H1.227_20AA_linker_scFv_6X-His SEQ ID NO: 540

DIVMTQSPATLSLSPGERATISC<u>RSSKSLQNVNGNTYLS</u>WFQQKPGQSPKLLIY<u>RMSNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSKSTAYMELSSLRSEDTAVYYCAR<u>GTYYYGTRVFDY</u>WGQGTLVTVSSGSHHHH
HH

4G7_L1.200_H1.227_20AA_linker_scFv_no His SEQ ID NO: 541

DIVMTQSPATLSLSPGERATISC<u>RSSKSLQNVNGNTYLS</u>WFQQKPGQSPKLLIY<u>RMSNLNS</u>GVPDRFSGSGSGTEFTLTISSLEPEDFA
VYYC<u>MQHLEYPIT</u>FGGGTKLEIKGGGGSGGGGSGGGGSGGGGSEVQLVESGGGLVKPGGSLKLSCAASGYTFT<u>SYVMH</u>WVRQAP
GGGLEWIG<u>YINPYNDGTKYNEKFKG</u>RVTISSDKSKSTAYMELSSLRSEDTAVYYCAR<u>GTYYYGTRVFDY</u>WGQGTLVTVSS

Figure 26

Stabilized anti-CD19 Fv variants

VH (4G7_H1.227) SEQ ID NO: 542

EVQLVESGGGLVKPGGSLKLSCAASGYTFTSYVMHWVRQAPGGGLEWIGYINPYNDGTKYNEKFKGRVTISSDKSKSTAYMELSSLR
SEDTAVYYCARGTYYYGTRVFDYWGQGTLVTVSS

VL (4G7_L1.198) SEQ ID NO: 543

DIVMTQSPATLSLSPGERATISCRSSKSLQNVNGNTYLYWFQQKPGQSPKLLIYRMSNLNSGVPDRFSGSGSGTEFTLTISSLEPEDFA
VYYCMQHLEYPITFGGGTKLEIK

VL (4G7_L1.199) SEQ ID NO: 544

DIVMTQSPATLSLSPGERATISCRSSKSLQNVNGNTYLYWFQQKPGQSPKLLIYRASNLNSGVPDRFSGSGSGTEFTLTISSLEPEDFA
VYYCMQHLEYPITFGGGTKLEIK

Figure 27A

Dual-scFv variants with stabilized anti-CD19 variable regions

4G7_L1.199_H1.227_20AA_linker_scFv_CD3_H1L1.4_scFv_Fc(216)_IgG1_pI_ISO(-)-pI_ISO(+RR)_C220S/ G236R/L328R Heavy chain 1 (4G7_L1.199_H1.227_20AA_linker_scFv-Fc(216)_IgG1_pI_ISO(-)_C220S/G236R/L328R)
SEQ ID NO: 545

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGGSGGGGSGGGGSGGGGSEVQLVESGGGLVKPGGSLKLSCAASGY
TFTSYVMHWVRQAPGGGLEWIGYINPYNDGTKYNEKFKGRVTISSDKSKSTAYMELSSLRSEDTAVYYCARGTYYYGTR
VFDYWGQGTLVTVSSEPKSSDKTHTCPPCPAPELLRGPSVFLFPPKPKDTLMISRTPEVTCVVVDVSHEDPEVQFNWYV
DGVEVHNAKTKPREEQYNSTYRVVSVLTVLHQDWLNGKEYKCKVSNKARPAPIEKTISKAKGQPREPQVYTLPPSQEE
MTKNQVSLTCLVKGFYPSDIAVEWESSGQPENNYNTTPPMLDSDGSFFLYSKLTVDKSRWQEGNVFSCSVMHEALHN
HYTQKSLSLSPG

Heavy chain 2 (CD3_H1L1.4_scFv_Fc(216)_IgG1_pI_ISO(+RR)_C220S/G236R/L328R) SEQ ID NO: 546

EVQLVESGGGLVQPGGSLRLSCAASGFTFNTYAMNWVRQAPGKGLEWVGRIRSKYNNYATYYADSVKGRFTISRDDS
KNTLYLQMNSLRAEDTAVYYCVRHGNFGNSYVSWFAYWGQGTLVTVSSGGGGSGGGGSGGGGSQAVVTQEPSLTV
SPGGTVTLTCGSSTGAVTTSNYANWVQQKPGQAPRGLIGGTNKRAPGVPARFSGSLLGGKAALTLSGAQPEDEAEYYC
ALWYSNLWVFGGGTKLTVLERKSSDKTHTCPRCPAPELLRGPSVFLFPPKPKDTLMISRTPEVTCVVVDVSHEDPEVKFK
WYVDGVEVHNAKTKPREEQYNSTYRVVSVLTVLHQDWLNGKEYKCKVSNKARPAPIEKTISKAKGQPREPQVYTLPPS
REEMTKNQVSLTCLVKGFYPSDIAVEWESNGQPENNYKTTPPVLDSDGSFFLYSKLTVDKSRWQQGNVFSCSVMHEAL
HNHYTQKSLSLSPGK

Figure 27B

4G7_H1.227_L1.198_20AA_linker_scFv_CD3_H1L1.4_scFv_Fc(216)_IgG1_pI_ISO(-)-pI_ISO(+RR)_C220S/ G236R/L328R Heavy chain 1 (4G7_H1.227_L1.198_20AA_linker_scFv-Fc(216)_IgG1_pI_ISO(-)_C220S/G236R/L328R)
SEQ ID NO: 547

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSGGGGSGGGGSGGGGSGGGGSDIVMTQSPATLSLS
PGERATISCRSSKSLQNVNGNTYLYWFQQKPGQSPKLLIYRMSNLNSGVPDRFSGSGSGTEFTLTISSLEPEDFAVYYCM
QHLEYPITFGGGTKLEIKEPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKGQPREPQVYTLPPSQEE
MTKNQVSLTCLVKGFYPSDIAVEWESSGQPENNYNTTPPMLDSDGSFFLYSKLTVDKSRWQEGNVFSCSVMHEALHN
HYTQKSLSLSPG

Heavy chain 2 (CD3_H1L1.4_scFv_Fc(216)_IgG1_pI_ISO(+RR)_C220S/G236R/L328R) SEQ ID NO: 548

EVQLVESGGGLVQPGGSLRLSCAASGFTFNTYAMNWVRQAPGKGLEWVGRIRSKYNNYATYYADSVKGRFTISRDDS
KNTLYLQMNSLRAEDTAVYYCVRHGNFGNSYVSWFAYWGQGTLVTVSSGGGGSGGGGSGGGGSQAVVTQEPSLTV
SPGGTVTLTCGSSTGAVTTSNYANWVQQKPGQAPRGLIGGTNKRAPGVPARFSGSLLGGKAALTLSGAQPEDEAEYYC
ALWYSNLWVFGGGTKLTVLERKSSDKTHTCPRCPAPELLRGPSVFLFPPKPKDTLMISRTPEVTCVVVDVSHEDPEVKFK
WYVDGVEVHNAKTKPREEQYNSTYRVVSVLTVLHQDWLNGKEYKCKVSNKARPAPIEKTISKAKGQPREPQVYTLPPS
REEMTKNQVSLTCLVKGFYPSDIAVEWESNGQPENNYKTTPPVLDSDGSFFLYSKLTVDKSRWQQGNVFSCSVMHEAL
HNHYTQKSLSLSPGK

Figure 28A

Bottle-opener variants with stabilized anti-CD19 Fvs

4G7_H1.227_L1.199_Fab-CD3_H1L1.4_scFv_Fc(216)_IgG1_pI_ISO(-)-pI_ISO(+RR)_C220S/G236R/L328R

Heavy chain 1 (4G7_H1.227_IgG1_pI_ISO(-)_G236R/L328R) SEQ ID NO: 549

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYTCNVDHKPSNTKVDKKVEPKSCDKTHTCPPCPAPEL
LRGPSVFLFPPKPKDTLMISRTPEVTCVVVDVSHEDPEVQFNWYVDGVEVHNAKTKPREEQYNSTYRVVSVLTVLHQD
WLNGKEYKCKVSNKARPAPIEKTISKAKGQPREPQVYTLPPSQEEMTKNQVSLTCLVKGFYPSDIAVEWESSGQPENNY
NTTPPMLDSDGSFFLYSKLTVDKSRWQEGNVFSCSVMHEALHNHYTQKSLSLSPG

Heavy chain 2 (CD3_H1L1.4_scFv_Fc(216)_IgG1_pI_ISO(+RR)_C220S/G236R/L328R) SEQ ID NO: 550

EVQLVESGGGLVQPGGSLRLSCAASGFTFNTYAMNWVRQAPGKGLEWVGRIRSKYNNYATYYADSVKGRFTISRDDS
KNTLYLQMNSLRAEDTAVYYCVRHGNFGNSYVSWFAYWGQGTLVTVSSGGGGSGGGGSGGGGSQAVVTQEPSLTV
SPGGTVTLTCGSSTGAVTTSNYANWVQQKPGQAPRGLIGGTNKRAPGVPARFSGSLLGGKAALTLSGAQPEDEAEYYC
ALWYSNLWVFGGGTKLTVLERKSSDKTHTCPRCPAPELLRGPSVFLFPPKPKDTLMISRTPEVTCVVVDVSHEDPEVKFK
WYVDGVEVHNAKTKPREEQYNSTYRVVSVLTVLHQDWLNGKEYKCKVSNKARPAPIEKTISKAKGQPREPQVYTLPPS
REEMTKNQVSLTCLVKGFYPSDIAVEWESNGQPENNYKTTPPVLDSDGSFFLYSKLTVDKSRWQQGNVFSCSVMHEAL
HNHYTQKSLSLSPGK

Light chain (4G7_L1.199) SEQ ID NO: 551

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 28B

4G7_H1.227_L1.198_Fab-CD3_H1L1.4_scFv_Fc(216)_IgG1_pI_ISO(-)-pI_ISO(+RR)_C220S/ G236R/L328R

Heavy chain 1 (4G7_H1.227_IgG1_pI_ISO(-)_G236R/L328R) SEQ ID NO: 552

EVQLVESGGGLVKPGGSLKLSCAASGYTFT<u>SYVMH</u>WVRQAPGGGLEWIG<u>YINPYNDGTKYNEKFKG</u>RVTISSDKSKSTAYMELSSLR
SEDTAVYYCAR<u>GTYYYGTRVFDY</u>WGQGTLVTVSSASTKGPSVFPLAPSSKSTSGGTAALGCLVKDYFPEPVTVSWNSGALTSGVHTF
PAVLQSSGLYSLSSVVTVPSSSLGTQTYTCNVDHKPSNTKVDKKVEPKSCDKTHTCPPCPAPELLRGPSVFLFPPKPKDTLMISRTPEV
TCVVVDVSHEDPEVQFNWYVDGVEVHNAKTKPREEQYNSTYRVVSVLTVLHQDWLNGKEYKCKVSNKARPAPIEKTISKAKGQPR
EPQVYTLPPSQEEMTKNQVSLTCLVKGFYPSDIAVEWESSGQPENNYNTTPPMLDSDGSFFLYSKLTVDKSRWQEGNVFSCSVMH
EALHNHYTQKSLSLSPG

Heavy chain 2 (CD3_H1L1.4_scFv_Fc(216)_IgG1_pI_ISO(+RR)_C220S/G236R/L328R) SEQ ID NO: 553

EVQLVESGGGLVQPGGSLRLSCAASGFTFNTYAMNWVRQAPGKGLEWVGRIRSKYNNYATYYADSVKGRFTISRDDS
KNTLYLQMNSLRAEDTAVYYCVRHGNFGNSYVSWFAYWGQGTLVTVSS<u>GGGGSGGGGSGGGGS</u>QAVVTQEPSLTV
SPGGTVTLTCGSSTGAVTTSNYANWVQQKPGQAPRGLIGGTNKRAPGVPARFSGSLLGGKAALTLSGAQPEDEAEYYC
ALWYSNLWVFGGGTKLTVLERKSSDKTHTCPRCPAPELLRGPSVFLFPPKPKDTLMISRTPEVTCVVVDVSHEDPEVKFK
WYVDGVEVHNAKTKPREEQYNSTYRVVSVLTVLHQDWLNGKEYKCKVSNKARPAPIEKTISKAKGQPREPQVYTLPPS
REEMTKNQVSLTCLVKGFYPSDIAVEWESNGQPENNYKTTPPVLDSDGSFFLYSKLTVDKSRWQQGNVFSCSVMHEAL
HNHYTQKSLSLSPGK

Light chain (4G7_L1.198) SEQ ID NO: 554

DIVMTQSPATLSLSPGERATISC<u>RSSKSLQNVNGNTYLY</u>WFQQKPGQSPKLLIY<u>RMSNLNS</u>GVPDRFSGSGSGTEFTLTISSLEPEDFA
VYYC<u>MQHLEYPIT</u>FGGGTKLEIKRTVAAPSVFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

Stabilized anti-CD19 variable regions – competition binding with labeled anti-CD19 IgG1 @ 1 μg/mL.

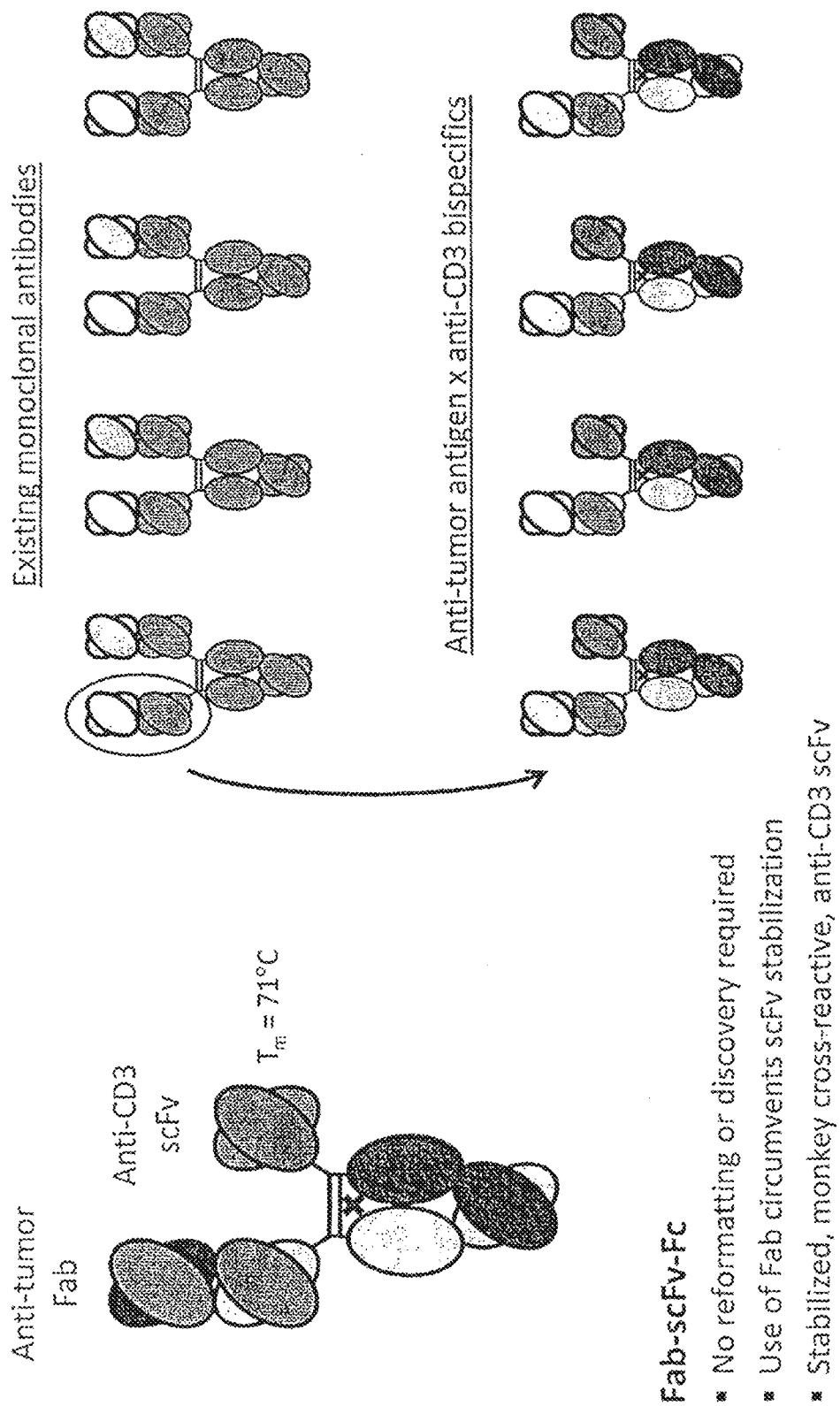

Figure 44

| XENP | VH ID | VL ID | VH Substitutions | VL Substitutions |
|---|---|---|---|---|
| 12912 | H1.79 | L1.48 | G44C | G100C |
| 13701 | H1.80 | L1.49 | Q105C | S43C |
| 13702 | H1.81 | L1.50 | Y100BC | G49C |
| 13703 | H1.81 | L1.51 | Y100BC | G50C |
| 13704 | H1.82 | L1.51 | D100C | G50C |
| 13705 | H1.83 | L1.52 | A101C | G46C |
| 13706 | H1.84 | L1.53 | Q39C | Q38C |
| 13707 | H1.85 | L1.54 | V89C | K42C |
| 13708 | H1.86 | L1.55 | V100CC | K53C |
| 13709 | H1.83 | L1.56 | A101C | A55C |

Figure 46

| XENP | Variant | Linker Sequence | SEQ ID NO | Length | Charge | Tm1 (°C) |
|---|---|---|---|---|---|---|
| 12241 | CD3_H1.30_L1.47_scFv_His | GGGGSGGGGSGGGGS | 555 | 15 | 0 | 68.0 |
| 12782 | CD3_H1.30_L1.47_scFv_His_scFvLinker(+A) | IRPRAIGGSKPRVA | 556 | 14 | +4 | 66.0 |
| 12783 | CD3_H1.30_L1.47_scFv_His_scFvLinker(+B) | GKGGSGKGGSGKGGS | 557 | 15 | +3 | 68.0 |
| 12784 | CD3_H1.30_L1.47_scFv_His_scFvLinker(+C) | GGGKSGGGKSGGGKS | 558 | 15 | +3 | 68.0 |
| 12785 | CD3_H1.30_L1.47_scFv_His_scFvLinker(+D) | GGGKSGGGKSGGGKS | 559 | 15 | +3 | 68.5 |
| 12786 | CD3_H1.30_L1.47_scFv_His_scFvLinker(+E) | GKGKSGKGKSGKGKS | 560 | 15 | +6 | 68.5 |
| 12787 | CD3_H1.30_L1.47_scFv_His_scFvLinker(+F) | GGGKSGGGKSGGGKGS | 561 | 15 | +3 | 68.0 |
| 12788 | CD3_H1.30_L1.47_scFv_His_scFvLinker(+G) | GKPGSGKPGSGKPGS | 562 | 15 | +3 | 68.0 |
| 12789 | CD3_H1.30_L1.47_scFv_His_scFvLinker(+H) | GKPGSGKPGSGKPGSGKPGS | 563 | 20 | +4 | 69.0 |
| 12790 | CD3_H1.30_L1.47_scFv_His_scFvLinker(+I) | GKGKSGKGKSGKGKSGKGKS | 564 | 20 | +8 | 69.5 |
| 11869 | 4G7_L1.199_H1.227_20AA_linker_scFv_6X-His | GGGGSGGGGSGGGGSGGGGS | 565 | 20 | 0 | 67.5 |
| 12791 | 4G7_L1.199_H1.227_14AA_linker_(-A)_scFv_6X-His | STAGDTHLGGEDFD | 566 | 14 | -4 | 64.5 |
| 12792 | 4G7_L1.199_H1.227_15AA_linker_(-B)_scFv_6X-His | GEGGSGEGGSGEGGS | 567 | 15 | -3 | 66.0 |
| 12793 | 4G7_L1.199_H1.227_15AA_linker_(-C)_scFv_6X-His | GGEGSGGEGSGGEGS | 568 | 15 | -3 | 66.5 |
| 12794 | 4G7_L1.199_H1.227_15AA_linker_(-D)_scFv_6X-His | GGGESGGGESGGGES | 569 | 15 | -3 | 67.0 |
| 12795 | 4G7_L1.199_H1.227_15AA_linker_(-E)_scFv_6X-His | GEGESGEGESGEGES | 570 | 15 | -6 | 65.5 |
| 12796 | 4G7_L1.199_H1.227_15AA_linker_(-F)_scFv_6X-His | GGGESGGEGSGEGGS | 571 | 15 | -3 | 66.5 |
| 12801 | 4G7_L1.199_H1.227_20AA_linker_(-G)_scFv_6X-His | GEGESGEGESGEGESGEGES | 572 | 20 | -8 | 67.0 |

Figure 53A

XENP11869 (4G7_L1.199_H1.227_20AA_linker_scFv_6X-His)

Single chain Fv (4G7_L1.199_H1.227_20AA_linker_scFv_6X-His)

SEQ ID NO: 573
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGGSGGGGSGGGGSGGGGSEVQLVESGGGLVKPGGSLKLSCAASGY
TFTSYVMHWVRQAPGGGLEWIGYINPYNDGTKYNEKFKGRVTISSDKSKSTAYMELSSLRSEDTAVYYCARGTYYYGTR
VFDYWGQGTLVTVSSSGHHHHHH

SEQ ID NO: 574
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGGSGGGGSGGGGSGGGGSEVQLVESGGGLVKPGGSLKLSCAASGY
TFTSYVMHWVRQAPGGGLEWIGYINPYNDGTKYNEKFKGRVTISSDKSKSTAYMELSSLRSEDTAVYYCARGTYYYGTR
VFDYWGQGTLVTVSSSG

XENP12241 (CD3_H1.30_L1.47_scFv_His)

Single chain Fv (CD3_H1.30_L1.47_scFv_His)

SEQ ID NO: 575
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGGSGGGGSGGGGSQAVVTQEPSLTVS
PGGTVTLTCGSSTGAVTTSNYANWVQQKPGKSPRGLIGGTNKRAPGVPARFSGSLLGGKAALTISGAQPEDEADYYCA
LWYSNHWVFGGGTKLTVLGSHHHHHH

SEQ ID NO: 576
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGGSGGGGSGGGGSQAVVTQEPSLTVS
PGGTVTLTCGSSTGAVTTSNYANWVQQKPGKSPRGLIGGTNKRAPGVPARFSGSLLGGKAALTISGAQPEDEADYYCA
LWYSNHWVFGGGTKLTVLGS

Figure 53B

XENP12482 (4G7_H1.227_L1.199_Fab-CD3_H1.30_L1.47_scFv_Fc(216)_IgG1_pI_ISO(-)-pI_ISO(+RR)_C220S/FcKO)

SEQ ID NO: 577

Heavy chain 1 (4G7_H1.227_IgG1_pI_ISO(-)_G236R/L328R)

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYTCNVDHKPSNTKVDKKVEPKSCDKTHTCPPCPAPEL
LRGPSVFLFPPKPKDTLMISRTPEVTCVVVDVSHEDPEVQFNWYVDGVEVHNAKTKPREEQYNSTYRVVSVLTVLHQD
WLNGKEYKCKVSNKARPAPIEKTISKAKGQPREPQVYTLPPSQEEMTKNQVSLTCLVKGFYPSDIAVEWESSGQPENNY
NTTPPMLDSDGSFFLYSKLTVDKSRWQEGNVFSCSVMHEALHNHYTQKSLSLSPG

SEQ ID NO: 578

Heavy chain 2 (CD3_H1.30_L1.47_scFv_Fc(216)_IgG1_pI_ISO(+RR)_C220S/G236R/L328R)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGGSGGGGSGGGGSQAVVTQEPSLTVS
PGGTVTLTCGSSTGAVTTSNYANWVQQKPGKSPRGLIGGTNKRAPGVPARFSGSLLGGKAALTISGAQPEDEADYYCA
LWYSNHWVFGGGTKLTVLERKSSDKTHTCPRCPAPELLRGPSVFLFPPKPKDTLMISRTPEVTCVVVDVSHEDPEVKFK
WYVDGVEVHNAKTKPREEQYNSTYRVVSVLTVLHQDWLNGKEYKCKVSNKARPAPIEKTISKAKGQPREPQVYTLPPS
REEMTKNQVSLTCLVKGFYPSDIAVEWESNGQPENNYKTTPPVLDSDGSFFLYSKLTVDKSRWQQGNVFSCSVMHEAL
HNHYTQKSLSLSPGK

SEQ ID NO: 579

Light chain (4G7_L1.199)

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

XENP12782 (CD3_H1.30_L1.47_scFv_His_scFvLinker(+A))

Single chain Fv (CD3_H1.30_L1.47_scFv_His_scFvLinker(+A))

SEQ ID NO: 580
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSIRPRAIGGSKPRVAQAVVTQEPSLTVSPGG
TVTLTCGSSTGAVTTSNYANWVQQKPGKSPRGLIGGTNKRAPGVPARFSGSLLGGKAALTISGAQPEDEADYYCALWY
SNHWVFGGGTKLTVLGSHHHHHH

Figure 53C

SEQ ID NO: 581
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSIRPRAIGGSKPRVAQAVVTQEPSLTVSPGG
TVTLTCGSSTGAVTTSNYANWVQQKPGKSPRGLIGGTNKRAPGVPARFSGSLLGGKAALTISGAQPEDEADYYCALWY
SNHWVFGGGTKLTVLGS

XENP12783 (CD3_H1.30_L1.47_scFv_His_scFvLinker(+B))

Single chain Fv (CD3_H1.30_L1.47_scFv_His_scFvLinker(+B))

SEQ ID NO: 582
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGGSGKGGSGKGGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGSHHHHHH

SEQ ID NO: 583
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGGSGKGGSGKGGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS

XENP12784 (CD3_H1.30_L1.47_scFv_His_scFvLinker(+C))

Single chain Fv (CD3_H1.30_L1.47_scFv_His_scFvLinker(+C))

SEQ ID NO: 584
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGKGSGGKGSGGKGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGSHHHHHH

SEQ ID NO: 585
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGKGSGGKGSGGKGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS

Figure 53D

XENP12785 (CD3_H1.30_L1.47_scFv_His_scFvLinker(+D))

Single chain Fv (CD3_H1.30_L1.47_scFv_His_scFvLinker(+D))

SEQ ID NO: 586
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGKSGGGKSGGGKSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS<u>HHHHHH</u>

SEQ ID NO: 587
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGKSGGGKSGGGKSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS

XENP12786 (CD3_H1.30_L1.47_scFv_His_scFvLinker(+E))

Single chain Fv (CD3_H1.30_L1.47_scFv_His_scFvLinker(+E))

SEQ ID NO: 588
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGKSGKGKSGKGKSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS<u>HHHHHH</u>

SEQ ID NO: 589
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGKSGKGKSGKGKSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS

XENP12787 (CD3_H1.30_L1.47_scFv_His_scFvLinker(+F))

Single chain Fv (CD3_H1.30_L1.47_scFv_His_scFvLinker(+F))

SEQ ID NO: 590
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGKSGGKGSGKGGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS<u>HHHHHH</u>

Figure 53E

SEQ ID NO: 591
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGKSGGKGSGKGGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS

XENP12788 (CD3_H1.30_L1.47_scFv_His_scFvLinker(+G))

Single chain Fv (CD3_H1.30_L1.47_scFv_His_scFvLinker(+G))

SEQ ID NO: 592
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGSHHHHHH

SEQ ID NO: 593
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLGS

XENP12789 (CD3_H1.30_L1.47_scFv_His_scFvLinker(+H))

Single chain Fv (CD3_H1.30_L1.47_scFv_His_scFvLinker(+H))

SEQ ID NO: 594
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLGSHHHHHH

SEQ ID NO: 595
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLGS

Figure 53F

XENP12790 (CD3_H1.30_L1.47_scFv_His_scFvLinker(+I))

Single chain Fv (CD3_H1.30_L1.47_scFv_His_scFvLinker(+I))

SEQ ID NO: 596
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGKSGKGKSGKGKSGKGKSQAVVTQEPS
LTVSPGGTVTLTCGSSTGAVTTSNYANWVQQKPGKSPRGLIGGTNKRAPGVPARFSGSLLGGKAALTISGAQPEDAD
YYCALWYSNHWVFGGGTKLTVLGS<u>HHHHHH</u>

SEQ ID NO: 597
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGKSGKGKSGKGKSGKGKSQAVVTQEPS
LTVSPGGTVTLTCGSSTGAVTTSNYANWVQQKPGKSPRGLIGGTNKRAPGVPARFSGSLLGGKAALTISGAQPEDAD
YYCALWYSNHWVFGGGTKLTVLGS

XENP12791 (4G7_L1.199_H1.227_14AA_linker_(-A)_scFv_6X-His)

Single chain Fv (4G7_L1.199_H1.227_14AA_linker_(-A)_scFv_6X-His)

SEQ ID NO: 598
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKSTAGDTHLGGEDFDEVQLVESGGGLVKPGGSLKLSCAASGYTFTSYVMH
WVRQAPGGGLEWIGYINPYNDGTKYNEKFKGRVTISSDKSKSTAYMELSSLRSEDTAVYYCARGTYYYGTRVFDYWGQ
GTLVTVSSSG<u>HHHHHH</u>

SEQ ID NO: 599
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKSTAGDTHLGGEDFDEVQLVESGGGLVKPGGSLKLSCAASGYTFTSYVMH
WVRQAPGGGLEWIGYINPYNDGTKYNEKFKGRVTISSDKSKSTAYMELSSLRSEDTAVYYCARGTYYYGTRVFDYWGQ
GTLVTVSSSG

XENP12792 (4G7_L1.199_H1.227_15AA_linker_(-B)_scFv_6X-His)

Single chain Fv (4G7_L1.199_H1.227_15AA_linker_(-B)_scFv_6X-His)

SEQ ID NO: 600
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGEGGSGEGGSGEGGSEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSG<u>HHHHHH</u>

Figure 53G

SEQ ID NO: 601
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGEGGSGEGGSGEGGSEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSG

XENP12793 (4G7_L1.199_H1.227_15AA_linker_(-C)_scFv_6X-His)

Single chain Fv (4G7_L1.199_H1.227_15AA_linker_(-C)_scFv_6X-His)

SEQ ID NO: 602
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGEGSGGEGSGGEGSEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSGHHHHHH

SEQ ID NO: 603
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGEGSGGEGSGGEGSEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSG

XENP12794 (4G7_L1.199_H1.227_15AA_linker_(-D)_scFv_6X-His)

Single chain Fv (4G7_L1.199_H1.227_15AA_linker_(-D)_scFv_6X-His)

SEQ ID NO: 604
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGESGGRESGGGESEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSGHHHHHH

SEQ ID NO: 605
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGESGGRESGGGESEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSG

Figure 53H

XENP12795 (4G7_L1.199_H1.227_15AA_linker_(-E)_scFv_6X-His)

Single chain Fv (4G7_L1.199_H1.227_15AA_linker_(-E)_scFv_6X-His)

SEQ ID NO: 606
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGEGESGEGESGEGESEVQLVESGGGLVKPGGSLKLSCAASGYTFTSYVM
HWVRQAPGGGLEWIGYINPYNDGTKYNEKFKGRVTISSDKSKSTAYMELSSLRSEDTAVYYCARGTYYYGTRVFDYWG
QGTLVTVSSSGHHHHHH

SEQ ID NO: 607
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGEGESGEGESGEGESEVQLVESGGGLVKPGGSLKLSCAASGYTFTSYVM
HWVRQAPGGGLEWIGYINPYNDGTKYNEKFKGRVTISSDKSKSTAYMELSSLRSEDTAVYYCARGTYYYGTRVFDYWG
QGTLVTVSSSG

XENP12796 (4G7_L1.199_H1.227_15AA_linker_(-F)_scFv_6X-His)

Single chain Fv (4G7_L1.199_H1.227_15AA_linker_(-F)_scFv_6X-His)

SEQ ID NO: 608

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGESGGEGSGEGGSEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSGHHHHH

SEQ ID NO: 609

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGGGESGGEGSGEGGSEVQLVESGGGLVKPGGSLKLSCAASGYTFTSYV
MHWVRQAPGGGLEWIGYINPYNDGTKYNEKFKGRVTISSDKSKSTAYMELSSLRSEDTAVYYCARGTYYYGTRVFDYW
GQGTLVTVSSSG

XENP12801 (4G7_L1.199_H1.227_15AA_linker_(-G)_scFv_6X-His)

Single chain Fv (4G7_L1.199_H1.227_15AA_linker_(-G)_scFv_6X-His)

SEQ ID NO: 610
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGEGESGEGESGEGESEVQLVESGGGLVKPGGSLKLSCAASGYTF
TSYVMHWVRQAPGGGLEWIGYINPYNDGTKYNEKFKGRVTISSDKSKSTAYMELSSLRSEDTAVYYCARGTYYYGTRVF
DYWGQGTLVTVSSSGHHHHHH

Figure 53I

SEQ ID NO: 611
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKGEGESGEGESGEGESGEGESEVQLVESGGGLVKPGGSLKLSCAASGYTF
TSYVMHWVRQAPGGGLEWIGYINPYNDGTKYNEKFKGRVTISSDKSKSTAYMELSSLRSEDTAVYYCARGTYYYGTRVF
DYWGQGTLVTVSSSG

XENP12968 (4G7_H1.227_L1.199_Fab-CD3_H1.30_L1.47_scFv_Fc(216)_IgG1_PVA_/S267K_pI_ISO(-NKV)-pI_ISO(+RR)_L368D/K370S-C220S/S364K/E357Q)

Heavy chain 1 (4G7_H1.227_IgG1_pI_ISO(-)_PVA_/S267K/L368D/K370S/S384N/N392K/M397V)

SEQ ID NO: 612
EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYTCNVDHKPSNTKVDKKVEPKSCDKTHTCPPCPAPP
VAGPSVFLFPPKPKDTLMISRTPEVTCVVVDVKHEDPEVQFNWYVDGVEVHNAKTKPREEQYNSTYRVVSVLTVLHQD
WLNGKEYKCKVSNKALPAPIEKTISKAKGQPREPQVYTLPPSQEEMTKNQVSLTCDVSGFYPSDIAVEWESNGQPENN
YKTTPPVLDSDGSFFLYSKLTVDKSRWQEGNVFSCSVMHEALHNHYTQKSLSLSPG

Heavy chain 2 (CD3_H1.30_L1.47_scFv_Fc(216)_IgG1_pI_ISO(+RR)_C220S/PVA_/S267K/S364K/E357Q)

SEQ ID NO: 613
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGGSGGGGSGGGGSQAVVTQEPSLTVS
PGGTVTLTCGSSTGAVTTSNYANWVQQKPGKSPRGLIGGTNKRAPGVPARFSGSLLGGKAALTISGAQPEDEADYYCA
LWYSNHWVFGGGTKLTVLERKSSDKTHTCPRCPAPPVAGPSVFLFPPKPKDTLMISRTPEVTCVVVDVKHEDPEVKFK
WYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEA
LHNHYTQKSLSLSPGK

Light chain (4G7_L1.199)

SEQ ID NO: 614
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 53J

XENP13121 (4G7_H1.227_L1.199_Fab-CD3_H1.30_L1.47_scFv_Fc(216)_IgG1_PVA_/S267K_pI(-)_Isosteric_A_L368D/K370S-IgG1_C220S/S364K/E357Q)

Heavy chain 1 (4G7_H1.227_IgG1_pI(-)_Isosteric_A_PVA_/S267K/L368D/K370S)

SEQ ID NO: 615

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

Heavy chain 2 (CD3_H1.30_L1.47_scFv_Fc(216)_IgG1_C220S/PVA_/S267K/S364K/E357Q)

SEQ ID NO: 616

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGGSGGGGSGGGGSQAVVTQEPSLTVS
PGGTVTLTCGSSTGAVTTSNYANWVQQKPGKSPRGLIGGTNKRAPGVPARFSGSLLGGKAALTISGAQPEDEADYYCA
LWYSNHWVFGGGTKLTVLEPKSSDKTHTCPPCPAPPVAGPSVFLFPPKPKDTLMISRTPEVTCVVVDVKHEDPEVKFN
WYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEA
LHNHYTQKSLSLSP

Light chain (4G7_L1.199)

SEQ ID NO: 617
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 53K

XENP13122 (4G7_H1.227_L1.199_Fab-
CD3_H1.30_L1.47_scFv(GKGGS)3_Fc(216)_IgG1_PVA_/S267K_pI(-)_Isosteric_A_L368D/K370S-
IgG1_C220S/S364K/E357Q)

Heavy chain 1 (4G7_H1.227_IgG1_pI(-)_Isosteric_A_PVA_/S267K/L368D/K370S)

SEQ ID NO: 618
EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

Heavy chain 2 (CD3_H1.30_L1.47_scFv(GKGGS)3_Fc(216)_IgG1_C220S/PVA_/S267K/S364K/E357Q)

SEQ ID NO: 619
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGGSGKGGSGKGGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLEPKSSDKTHTCPPCPAPPVAGPSVFLFPPKPKDTLMISRTPEVTCVVVDVKHEDPEVKFNW
YVDGVEVHNAKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCSVMHEALH
NHYTQKSLSLSPGK

Light chain (4G7_L1.199)

SEQ ID NO: 620
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGE

Figure 53L

XENP13123 (4G7_H1.227_L1.199_Fab-
CD3_H1.30_L1.47_scFv(GKPGS)3_Fc(216)_IgG1_PVA_/S267K_pI(-)_Isosteric_A_L368D/K370S-
IgG1_C220S/S364K/E357Q)

Heavy chain 1 (4G7_H1.227_IgG1_pI(-)_Isosteric_A_PVA_/S267K/L368D/K370S)

SEQ ID NO: 621
EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

Heavy chain 2 (CD3_H1.30_L1.47_scFv(GKPGS)3_Fc(216)_IgG1_C220S/PVA_/S267K/S364K/E357Q)

SEQ ID NO: 622
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLEPKSSDKTHTCPPCPAPPVAGPSVFLFPPKPKDTLMISRTPEVTCVVVDVKHEDPEVKFNW
YVDGVEVHNAKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCSVMHEALH
NHYTQKSLSLSPGK

Light chain (4G7_L1.199)

SEQ ID NO: 623

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 53M

XENP13124 (4G7_H1.227_L1.199_Fab-CD3_H1.30_L1.47_scFv(GKPGS)4_Fc(216)_IgG1_PVA_/S267K_pI(-)_Isosteric_A_L368D/K370S-IgG1_C220S/S364K/E357Q)

Heavy chain 1 (4G7_H1.227_IgG1_pI(-)_Isosteric_A_PVA_/S267K/L368D/K370S)

SEQ ID NO: 624
EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

Heavy chain 2 (CD3_H1.30_L1.47_scFv(GKPGS)4_Fc(216)_IgG1_C220S/PVA_/S267K/S364K/E357Q)

SEQ ID NO: 625
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (4G7_L1.199)

SEQ ID NO: 626
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 53N

XENP13125 (4G7_H1.227_L1.199_Fab-CD3_H1.30_L1.47_scFv(GKGKS)3_Fc(216)_IgG1_PVA_/S267K_pI(-)_Isosteric_A_L368D/K370S-IgG1_C220S/S364K/E357Q)

Heavy chain 1 (4G7_H1.227_IgG1_pI(-)_Isosteric_A_PVA_/S267K/L368D/K370S)

SEQ ID NO: 627
EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

Heavy chain 2 (CD3_H1.30_L1.47_scFv(GKGKS)3_Fc(216)_IgG1_C220S/PVA_/S267K/S364K/E357Q)

SEQ ID NO: 628
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKGKSGKGKSGKGKSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVLEPKSSDKTHTCPPCPAPPVAGPSVFLFPPKPKDTLMISRTPEVTCVVVDVKHEDPEVKFNW
YVDGVEVHNAKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCSVMHEALH
NHYTQKSLSLSPGK

Light chain (4G7_L1.199)

SEQ ID NO: 629
DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 53O

XENP13126 (4G7_H1.227_L1.199_Fab-CD3_H1.30_L1.47_scFv(GKPGS)4_Fc(216)_IgG1_pI(-)_Isosteric_A_L368D/K370S-IgG1_C220S/PVA_/S267K/E269Q/S364K/E357Q)

Heavy chain 1 (4G7_H1.227_IgG1_pI(-)_Isosteric_A_PVA_/S267K/L368D/K370S)

SEQ ID NO: 630

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

Heavy chain 2
(CD3_H1.30_L1.47_scFv(GKPGS)4_Fc(216)_IgG1_C220S/PVA_/S267K/E269Q/S363K/E357Q)

SEQ ID NO: 631

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDAD
YYCALWYSNHWVFGGGTKLTVLEPKSSDKTHTCPPCPAPPVAGPSVFLFPPKPKDTLMISRTPEVTCVVVDVKHQDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Light chain (4G7_L1.199)

SEQ ID NO: 632

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

FIGURE 54 Ablation Variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | |
| A327Q | |
| L328E | |
| L328R | |
| P329A | |
| P329H | |

Figure 55

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric_B | N208D Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

Figure 56

| Protein # | Name | Calculated pI | | |
|---|---|---|---|---|
| | | homodimer 1 | heterodimer | homodimer 2 |
| 12778 | Bevacizumab_IgG1_pI(-)_Isosteric_A_pI(+)_Isosteric_A | 6.77 | 8.12 | 8.61 |
| 12779 | Bevacizumab_IgG1_pI(-)_Isosteric_A_pI(+)_Isosteric_B | 6.77 | 8.04 | 8.53 |
| 12780 | Bevacizumab_IgG1_pI(-)_Isosteric_B_pI(+)_Isosteric_A | 7.02 | 8.19 | 8.61 |
| 12781 | Bevacizumab_IgG1_pI(-)_Isosteric_B_pI(+)_Isosteric_B | 7.02 | 8.12 | 8.53 |
| 12876 | empty-Fc(216)_IgG1_C220S_pI(-)_Isosteric_A_pI(+)_Isosteric_A | 6.01 | 7.34 | 8.67 |
| 12877 | empty-Fc(216)_IgG1_C220S_pI(-)_Isosteric_A_pI(+)_Isosteric_B | 6.01 | 7.00 | 8.50 |
| 12878 | empty-Fc(216)_IgG1_C220S_pI(-)_Isosteric_B_pI(+)_Isosteric_A | 6.20 | 7.68 | 8.67 |
| 12879 | empty-Fc(216)_IgG1_C220S_pI(-)_Isosteric_B_pI(+)_Isosteric_B | 6.20 | 7.34 | 8.50 |
| 13228 | 4G7_H1.227_L1.199_Fab-SP34_H1.30_L1.47_scFv_Fc(216)_IgG1_PVA_/S267K_pI(-)_Isosteric_A_WT-IgG1_C220S | 7.84 | 8.38 | 8.81 |

Figure 60

| XENP | Variant | Subs | Tm | ΔTm |
|---|---|---|---|---|
| 4547 | Bevacizumab - Avastin - IgG1 WT | WT | 68.5 | |
| 12774 | Bevacizumab_IgG1_pI(-)_Isosteric_A | N208D Q295E N384D Q418E N421D | 69.0 | 0.5 |
| 12775 | Bevacizumab_IgG1_pI(-)_Isosteric_B | N208D Q295E Q418E N421D | 68.5 | 0.0 |
| 12776 | Bevacizumab_IgG1_pI(+)_Isosteric_A | E269Q E272Q E283Q E357Q | 60.0 | -8.5 |
| 12777 | Bevacizumab_IgG1_pI(+)_Isosteric_B | E269Q E272Q E283Q | 60.0 | -8.5 |
| 12948 | Bevacizumab_IgG1_pI(+/+)_Isosteric_E272Q/E283Q | E272Q E283Q | 60.5 | -8.0 |
| 12949 | Bevacizumab_IgG1_pI(+/+)_Isosteric_E269Q/E283Q | E269Q E283Q | 63.5 | -5.0 |
| 12950 | Bevacizumab_IgG1_pI(+/+)_Isosteric_E269Q/E272Q | E269Q E272Q | 64.5 | -4.0 |
| 12951 | Bevacizumab_IgG1_pI(+/+)_Isosteric_E269Q | E269Q | 68.5 | 0.0 |
| 12952 | empty-Fc(216)_IgG1_C220S_pI(+/+)_Isosteric_E272Q/E283Q | E272Q E283Q | 59.5 | -9.0 |
| 12953 | empty-Fc(216)_IgG1_C220S_pI(+/+)_Isosteric_E269Q/E283Q | E269Q E283Q | 63.5 | -5.0 |
| 12954 | empty-Fc(216)_IgG1_C220S_pI(+/+)_Isosteric_E269Q/E272Q | E269Q E272Q | 64.0 | -4.5 |
| 12955 | empty-Fc(216)_IgG1_C220S_pI(+/+)_Isosteric_E269Q | E269Q | 67.5 | -1.0 |

Figure 61A

XENP4547 (Bevacizumab - Avastin - IgG1 WT)

Heavy chain (Bevacizumab - Avastin - WT - IgG1 Heavy)
SEQ ID No: 633
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK Light chain (Bevacizumab Avastin L0)
SEQ ID No: 634
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12774 (Bevacizumab_IgG1_pI(-)_Isosteric_A)

Heavy chain (Bevacizumab_IgG1_pI(-)_Isosteric_A)

SEQ ID No: 635

EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTCPPC
PAPELLGGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCLVKGFYPSDIAVEWESDGQPE
NNYKTTPPVLDSDGSFFLYSKLTVDKSRWEQGDVFSCSVMHEALHNHYTQKSLSLSPGK

Light chain (Bevacizumab Avastin L0)
SEQ ID No: 636
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 61B

XENP12775 (Bevacizumab_IgG1_pI(-)_Isosteric_B)

Heavy chain (Bevacizumab_IgG1_pI(-)_Isosteric_B)
SEQ ID No: 637
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTCPPC
PAPELLGGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWEQGDVFSCSVMHEALHNHYTQKSLSLSPGK Light chain (Bevacizumab Avastin L0)
SEQ ID No: 638
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12776 (Bevacizumab_IgG1_pI(+)_Isosteric_A)

Heavy chain (Bevacizumab_IgG1_pI(+)_Isosteric_A)
SEQ ID No: 639
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPQVKFKWYVDGVQVHNAKTKPREEQYNSTYRVVSVLT
VLHQDWLNGKEYKCKVSNKALPAPIEKTISKAKGQPREPQVYTLPPSREQMTKNQVSLTCLVKGFYPSDIAVEWESNG
QPENNYKTTPPVLDSDGSFFLYSKLTVDKSRWQQGNVFSCSVMHEALHNHYTQKSLSLSPGK Light chain (Bevacizumab Avastin L0)
SEQ ID No: 640
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 61C

XENP12777 (Bevacizumab_IgG1_pI(+)_Isosteric_B)

Heavy chain (Bevacizumab_IgG1_pI(+)_Isosteric_B)
SEQ ID No: 641
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPQVKFNWYVDGVQVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK Light chain (Bevacizumab Avastin L0)
SEQ ID No: 642
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12778 (Bevacizumab_IgG1_pI(-)_Isosteric_A_pI(+)_Isosteric_A)

Heavy chain 1 (Bevacizumab_IgG1_pI(-)_Isosteric_A)
SEQ ID No: 643
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTCPPC
PAPELLGGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCLVKGFYPSDIAVEWESDGQPE
NNYKTTPPVLDSDGSFFLYSKLTVDKSRWEQGDVFSCSVMHEALHNHYTQKSLSLSPGK Heavy chain 2 (Bevacizumab_IgG1_pI(+)_Isosteric_A)
SEQ ID No: 644
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPQVKFKWYVDGVQVHNAKTKPREEQYNSTYRVVSVLT
VLHQDWLNGKEYKCKVSNKALPAPIEKTISKAKGQPREPQVYTLPPSREQMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Figure 61D

Light chain (Bevacizumab Avastin L0)
SEQ ID No: 645
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12779 (Bevacizumab_IgG1_pI(-)_Isosteric_A_pI(+)_Isosteric_B)

Heavy chain 1 (Bevacizumab_IgG1_pI(-)_Isosteric_A)
SEQ ID No: 646
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTCPPC
PAPELLGGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCLVKGFYPSDIAVEWESDGQPE
NNYKTTPPVLDSDGSFFLYSKLTVDKSRWEQGDVFSCSVMHEALHNHYTQKSLSLSPGK Heavy chain 2 (Bevacizumab_IgG1_pI(+)_Isosteric_B)
SEQ ID No: 647
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPQVKFNWYVDGVQVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK Light chain (Bevacizumab Avastin L0)
SEQ ID No: 648
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12780 (Bevacizumab_IgG1_pI(-)_Isosteric_B_pI(+)_Isosteric_A)

Heavy chain 1 (Bevacizumab_IgG1_pI(-)_Isosteric_B)

SEQ ID No: 649

Figure 61E

EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTCPPC
PAPELLGGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWEQGDVFSCSVMHEALHNHYTQKSLSLSPGK

Heavy chain 2 (Bevacizumab_IgG1_pI(+)_Isosteric_A)

SEQ ID No: 650
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPQVKFKWYVDGVQVHNAKTKPREEQYNSTYRVVSVLT
VLHQDWLNGKEYKCKVSNKALPAPIEKTISKAKGQPREPQVYTLPPSREQMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light chain (Bevacizumab Avastin L0)

SEQ ID No: 651
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12781 (Bevacizumab_IgG1_pI(-)_Isosteric_B_pI(+)_Isosteric_B)

Heavy chain 1 (Bevacizumab_IgG1_pI(-)_Isosteric_B)

SEQ ID No: 652
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTCPPC
PAPELLGGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWEQGDVFSCSVMHEALHNHYTQKSLSLSPGK

Heavy chain 2 (Bevacizumab_IgG1_pI(+)_Isosteric_B) SEQ ID No: 653

EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC

Figure 61F

PAPELLGGPSVFLFPPKPKDTLMISRTPEVTCVVVDVSHQDPQVKFNWYVDGVQVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK

Light chain (Bevacizumab Avastin L0)

SEQ ID No: 654
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12876 (empty-Fc(216)_IgG1_C220S_pI(-)_Isosteric_A_pI(+)_Isosteric_A)

Heavy chain 1 (empty-Fc(216)_IgG1_C220S_pI(-)_Isosteric_A)

SEQ ID No: 655
EPKSSDKTHTCPPCPAPELLGGPSVFLFPPKPKDTLMISRTPEVTCVVVDVSHEDPEVKFNWYVDGVEVHNAKTKPREE
EYNSTYRVVSVLTVLHQDWLNGKEYKCKVSNKALPAPIEKTISKAKGQPREPQVYTLPPSREEMTKNQVSLTCLVKGFYP
SDIAVEWESDGQPENNYKTTPPVLDSDGSFFLYSKLTVDKSRWEQGDVFSCSVMHEALHNHYTQKSLSLSPGK

Heavy chain 2 (empty-Fc(216)_IgG1_C220S_pI(+)_Isosteric_A)

SEQ ID No: 656
EPKSSDKTHTCPPCPAPELLGGPSVFLFPPKPKDTLMISRTPEVTCVVVDVSHQDPQVKFNWYVDGVQVHNAKTKPRE
EQYNSTYRVVSVLTVLHQDWLNGKEYKCKVSNKALPAPIEKTISKAKGQPREPQVYTLPPSREQMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP12877 (empty-Fc(216)_IgG1_C220S_pI(-)_Isosteric_A_pI(+)_Isosteric_B)

Heavy chain 1 (empty-Fc(216)_IgG1_C220S_pI(-)_Isosteric_A)

SEQ ID No: 657
EPKSSDKTHTCPPCPAPELLGGPSVFLFPPKPKDTLMISRTPEVTCVVVDVSHEDPEVKFNWYVDGVEVHNAKTKPREE
EYNSTYRVVSVLTVLHQDWLNGKEYKCKVSNKALPAPIEKTISKAKGQPREPQVYTLPPSREEMTKNQVSLTCLVKGFYP
SDIAVEWESDGQPENNYKTTPPVLDSDGSFFLYSKLTVDKSRWEQGDVFSCSVMHEALHNHYTQKSLSLSPGK

Heavy chain 2 (empty-Fc(216)_IgG1_C220S_pI(+)_Isosteric_B)

SEQ ID No: 658
EPKSSDKTHTCPPCPAPELLGGPSVFLFPPKPKDTLMISRTPEVTCVVVDVSHQDPQVKFNWYVDGVQVHNAKTKPRE
EQYNSTYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

Figure 61G

XENP12878 (empty-Fc(216)_IgG1_C220S_pI(-)_Isosteric_B_pI(+)_Isosteric_A)

Heavy chain 1 (empty-Fc(216)_IgG1_C220S_pI(-)_Isosteric_B)

SEQ ID No: 659
EPKSSDKTHTCPPCPAPELLGGPSVFLFPPKPKDTLMISRTPEVTCVVVDVSHEDPEVKFNWYVDGVEVHNAKTKPREE
EYNSTYRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWEQGDVFSCSVMHEALHNHYTQKSLSLSPGK

Heavy chain 2 (empty-Fc(216)_IgG1_C220S_pI(+)_Isosteric_A)

SEQ ID No: 660
EPKSSDKTHTCPPCPAPELLGGPSVFLFPPKPKDTLMISRTPEVTCVVVDVSHQDPQVKFNWYVDGVQVHNAKTKPRE
EQYNSTYRVVSVLTVLHQDWLNGKEYKCKVSNKALPAPIEKTISKAKGQPREPQVYTLPPSREQMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP12879 (empty-Fc(216)_IgG1_C220S_pI(-)_Isosteric_B_pI(+)_Isosteric_B)

Heavy chain 1 (empty-Fc(216)_IgG1_C220S_pI(-)_Isosteric_B)

SEQ ID No: 661
EPKSSDKTHTCPPCPAPELLGGPSVFLFPPKPKDTLMISRTPEVTCVVVDVSHEDPEVKFNWYVDGVEVHNAKTKPREE
EYNSTYRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWEQGDVFSCSVMHEALHNHYTQKSLSLSPGK

Heavy chain 2 (empty-Fc(216)_IgG1_C220S_pI(+)_Isosteric_B)

SEQ ID No: 662
EPKSSDKTHTCPPCPAPELLGGPSVFLFPPKPKDTLMISRTPEVTCVVVDVSHQDPQVKFNWYVDGVQVHNAKTKPRE
EQYNSTYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

XENP12948 (Bevacizumab_IgG1_pI(+/+)_Isosteric_E272Q/E283Q)

Heavy chain (Bevacizumab_IgG1_pI(+)_Isosteric_E272Q/E283Q)

SEQ ID No: 663
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHEDPQVKFNWYVDGVQVHNAKTKPREEQYNSTYRVVSVLT

Figure 61H

VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK

Light chain (Bevacizumab Avastin L0)

SEQ ID No: 664
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12949 (Bevacizumab_IgG1_pI(+/+)_Isosteric_E269Q/E283Q)

Heavy chain (Bevacizumab_IgG1_pI(+)_Isosteric_E269Q/E283Q)

SEQ ID No: 665
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPEVKFNWYVDGVQVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK

Light chain (Bevacizumab Avastin L0)

SEQ ID No: 666
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12950 (Bevacizumab_IgG1_pI(+/+)_Isosteric_E269Q/E272Q)

Heavy chain (Bevacizumab_IgG1_pI(+)_Isosteric_E269Q/E272Q)

SEQ ID No: 667
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPQVKFNWYVDGVEVHNAKTKPREEQYNSTYRVVSVLT

Figure 6II

VLHQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK

Light chain (Bevacizumab Avastin L0)

SEQ ID No: 668
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12951 (Bevacizumab_IgG1_pI(+/+)_Isosteric_E269Q)

Heavy chain (Bevacizumab_IgG1_pI(+)_Isosteric_E269Q)

SEQ ID No: 669
EVQLVESGGGLVQPGGSLRLSCAASGYTFTNYGMNWVRQAPGKGLEWVGWINTYTGEPTYAADFKRRFTFSLDTSKS
TAYLQMNSLRAEDTAVYYCAKYPHYYGSSHWYFDVWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTCPPC
PAPELLGGPSVFLFPPKPKDTLMISRTPEVTCVVVDVSHQDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK

Light chain (Bevacizumab Avastin L0)

SEQ ID No: 670
DIQMTQSPSSLSASVGDRVTITCSASQDISNYLNWYQQKPGKAPKVLIYFTSSLHSGVPSRFSGSGSGTDFTLTISSLQPE
DFATYYCQQYSTVPWTFGQGTKVEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

XENP12952 (empty-Fc(216)_IgG1_C220S_pI(+/+)_Isosteric_E272Q/E283Q)

Heavy chain (empty-Fc(216)_IgG1_C220S_pI(+)_Isosteric_E272Q/E283Q)

SEQ ID No: 671
EPKSSDKTHTCPPCPAPELLGGPSVFLFPPKPKDTLMISRTPEVTCVVVDVSHEDPQVKFNWYVDGVQVHNAKTKPREE
QYNSTYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

Figure 61J

XENP12953 (empty-Fc(216)_IgG1_C220S_pI(+/+)_Isosteric_E269Q/E283Q)

Heavy chain (empty-Fc(216)_IgG1_C220S_pI(+)_Isosteric_E269Q/E283Q)

SEQ ID No: 672
EPKSSDKTHTCPPCPAPELLGGPSVFLFPPKPKDTLMISRTPEVTCVVVDVSHQDPEVKFNWYVDGVQVHNAKTKPREE
QYNSTYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

XENP12954 (empty-Fc(216)_IgG1_C220S_pI(+/+)_Isosteric_E269Q/E272Q)

Heavy chain (empty-Fc(216)_IgG1_C220S_pI(+)_Isosteric_E269Q/E272Q)

SEQ ID No: 673
EPKSSDKTHTCPPCPAPELLGGPSVFLFPPKPKDTLMISRTPEVTCVVVDVSHQDPQVKFNWYVDGVEVHNAKTKPREE
QYNSTYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

XENP12955 (empty-Fc(216)_IgG1_C220S_pI(+/+)_Isosteric_E269Q)

Heavy chain (empty-Fc(216)_IgG1_C220S_pI(+)_Isosteric_E269Q)

SEQ ID No: 674
EPKSSDKTHTCPPCPAPELLGGPSVFLFPPKPKDTLMISRTPEVTCVVVDVSHQDPEVKFNWYVDGVEVHNAKTKPREE
QYNSTYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

XENP13228 (4G7_H1.227_L1.199_Fab-SP34_H1.30_L1.47_scFv_Fc(216)_IgG1_PVA_/S267K_pI(-)_Isosteric_A_WT-IgG1_C220S)

Heavy chain 1 (4G7_H1.227_IgG1_pI(-)_Isosteric_A_PVA_/S267K)

SEQ ID No: 675
EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCLVKGFYPSDIAVEWESDGQPENNYKT
TPPVLDSDGSFFLYSKLTVDKSRWEQGDVFSCSVMHEALHNHYTQKSLSLSPGK

Figure 61K

Heavy chain 2 (SP34_H1.30_L1.47_scFv_Fc(216)_IgG1_C220S/PVA_/S267K)

SEQ ID No: 676

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGGGGSGGGGSGGGGSQAVVTQEPSLTVS
PGGTVTLTCGSSTGAVTTSNYANWVQQKPGKSPRGLIGGTNKRAPGVPARFSGSLLGGKAALTISGAQPEDEADYYCA
LWYSNHWVFGGGTKLTVLEPKSSDKTHTCPPCPAPPVAGPSVFLFPPKPKDTLMISRTPEVTCVVVDVKHEDPEVKFN
WYVDGVEVHNAKTKPREEQYNSTYRVVSVLTVLHQDWLNGKEYKCKVSNKALPAPIEKTISKAKGQPREPQVYTLPPS
REEMTKNQVSLTCLVKGFYPSDIAVEWESNGQPENNYKTTPPVLDSDGSFFLYSKLTVDKSRWQQGNVFSCSVMHEAL
HNHYTQKSLSLSPGK

Light chain (4G7_L1.199)

SEQ ID No: 677

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 62A

XENP12912 H1.79_L1.48

SEQ ID NO:685

EVQLVESGGGLVQPGGSLRLSCAASGFTFSTYAMNWVRQAPGKCLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGCGTKLTVLGSHHHHHH

SEQ ID NO:686

EVQLVESGGGLVQPGGSLRLSCAASGFTFSTYAMNWVRQAPGKCLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGCGTKLTVL

SEQ ID NO:687

EVQLVESGGGLVQPGGSLRLSCAASGFTFSTYAMNWVRQAPGKCLEWVGRIRSKYNNYATYYADSVKGRF
TISRDDSKNTLYLQMNSLRAEDTAVYYCVRHGNFGDSYVSWFAYWGQGTLVTVSS

SEQ ID NO:688

QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGCGTKLTVL

XENP13701 H1.80_L1.49

SEQ ID NO:689

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGCGTLVTVSSGGGGSGGGGSGGGGS
QAVVTQEPSLTVSPGGTVTLTCGSSTGAVTTSNYANWVQQKPGKCPRGLIGGTNKRAPGVPARFSGSLLG
GKAALTISGAQPEDEADYYCALWYSNHWVFGGGTKLTVLGSHHHHHH

SEQ ID NO:690

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGCGTLVTVSSGGGGSGGGGSGGGGS
QAVVTQEPSLTVSPGGTVTLTCGSSTGAVTTSNYANWVQQKPGKCPRGLIGGTNKRAPGVPARFSGSLLG
GKAALTISGAQPEDEADYYCALWYSNHWVFGGGTKLTVL

SEQ ID NO:691

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGCGTLVTVSS

Figure 62B

SEQ ID NO:692

QAVVTQEPSLTVSPGGTVTLTCGSSTGAVTTSNYANWVQQKPGKCPRGLIGGTNKRAPGVPARFSGSLLG
GKAALTISGAQPEDEADYYCALWYSNHWVFGGGTKLTVL

XENP13702 H1.81_L1.50

SEQ ID NO:693

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSCVSWFAYWGQGTLVTVSSGGGGSGGGGSGGGGS
QAVVTQEPSLTVSPGGTVTLTCGSSTGAVTTSNYANWVQQKPGKSPRGLICGTNKRAPGVPARFSGSLLG
GKAALTISGAQPEDEADYYCALWYSNHWVFGGGTKLTVLGSHHHHHH

SEQ ID NO:694

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSCVSWFAYWGQGTLVTVSSGGGGSGGGGSGGGGS
QAVVTQEPSLTVSPGGTVTLTCGSSTGAVTTSNYANWVQQKPGKSPRGLICGTNKRAPGVPARFSGSLLG
GKAALTISGAQPEDEADYYCALWYSNHWVFGGGTKLTVL

SEQ ID NO:695

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSCVSWFAYWGQGTLVTVSS

SEQ ID NO:696

QAVVTQEPSLTVSPGGTVTLTCGSSTGAVTTSNYANWVQQKPGKSPRGLICGTNKRAPGVPARFSGSLLG
GKAALTISGAQPEDEADYYCALWYSNHWVFGGGTKLTVL

XENP13703 H1.81_L1.51

SEQ ID NO:697

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSCVSWFAYWGQGTLVTVSSGGGGSGGGGSGGGGS
QAVVTQEPSLTVSPGGTVTLTCGSSTGAVTTSNYANWVQQKPGKSPRGLIGCTNKRAPGVPARFSGSLLG
GKAALTISGAQPEDEADYYCALWYSNHWVFGGGTKLTVLGSHHHHHH

Figure 62C

SEQ ID NO:698

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSCVSWFAYWGQGTLVTVSSGGGSGGGGSGGGGS
QAVVTQEPSLTVSPGGTVTLTCGSSTGAVTTSNYANWVQQKPGKSPRGLIGCTNKRAPGVPARFSGSLLG
GKAALTISGAQPEDEADYYCALWYSNHWVFGGGTKLTVL

SEQ ID NO:699

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSCVSWFAYWGQGTLVTVSS

SEQ ID NO:700

QAVVTQEPSLTVSPGGTVTLTCGSSTGAVTTSNYANWVQQKPGKSPRGLIGCTNKRAPGVPARFSGSLLG
GKAALTISGAQPEDEADYYCALWYSNHWVFGGGTKLTVL

XENP13704 H1.82_L1.51

SEQ ID NO:701

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGCSYVSWFAYWGQGTLVTVSSGGGSGGGGSGGGGS
QAVVTQEPSLTVSPGGTVTLTCGSSTGAVTTSNYANWVQQKPGKSPRGLIGCTNKRAPGVPARFSGSLLG
GKAALTISGAQPEDEADYYCALWYSNHWVFGGGTKLTVLGSHHHHHH

SEQ ID NO:702

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGCSYVSWFAYWGQGTLVTVSSGGGSGGGGSGGGGS
QAVVTQEPSLTVSPGGTVTLTCGSSTGAVTTSNYANWVQQKPGKSPRGLIGCTNKRAPGVPARFSGSLLG
GKAALTISGAQPEDEADYYCALWYSNHWVFGGGTKLTVL

SEQ ID NO:703

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGCSYVSWFAYWGQGTLVTVSS

SEQ ID NO:704

QAVVTQEPSLTVSPGGTVTLTCGSSTGAVTTSNYANWVQQKPGKSPRGLIGCTNKRAPGVPARFSGSLLG
GKAALTISGAQPEDEADYYCALWYSNHWVFGGGTKLTVL

Figure 62D

XENP13705 H1.83_L1.52

SEQ ID NO:705

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFCYWGQGTLVTVSSGGGGSGGGGSGGGGS
QAVVTQEPSLTVSPGGTVTLTCGSSTGAVTTSNYANWVQQKPGKSPRCLIGGTNKRAPGVPARFSGSLLG
GKAALTISGAQPEDEADYYCALWYSNHWVFGGGTKLTVLGSHHHHHH

SEQ ID NO:706

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFCYWGQGTLVTVSSGGGGSGGGGSGGGGS
QAVVTQEPSLTVSPGGTVTLTCGSSTGAVTTSNYANWVQQKPGKSPRCLIGGTNKRAPGVPARFSGSLLG
GKAALTISGAQPEDEADYYCALWYSNHWVFGGGTKLTVL

SEQ ID NO:707

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFCYWGQGTLVTVSS

SEQ ID NO:708

QAVVTQEPSLTVSPGGTVTLTCGSSTGAVTTSNYANWVQQKPGKSPRCLIGGTNKRAPGVPARFSGSLLG
GKAALTISGAQPEDEADYYCALWYSNHWVFGGGTKLTVL

XENP13706 H1.84_L1.53

SEQ ID NO:709

EVQLVESGGGLVQPGGSLRLSCAASGFTFSTYAMNWVRCAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQCKPGKSPRGLIGGTNKRAPGVPARFSGSLLG
GKAALTISGAQPEDEADYYCALWYSNHWVFGGGTKLTVLGSHHHHHH

SEQ ID NO:710

EVQLVESGGGLVQPGGSLRLSCAASGFTFSTYAMNWVRCAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQCKPGKSPRGLIGGTNKRAPGVPARFSGSLLG
GKAALTISGAQPEDEADYYCALWYSNHWVFGGGTKLTVL

SEQ ID NO:711

EVQLVESGGGLVQPGGSLRLSCAASGFTFSTYAMNWVRCAPGKGLEWVGRIRSKYNNYATYYADSVKGRF
TISRDDSKNTLYLQMNSLRAEDTAVYYCVRHGNFGDSYVSWFAYWGQGTLVTVSS

Figure 62E

SEQ ID NO:712

QAVVTQEPSLTVSPGGTVTLTCGSSTGAVTTSNYANWVQCKPGKSPRGLIGGTNKRAPGVPARFSGSLLG
GKAALTISGAQPEDEADYYCALWYSNHWVFGGGTKLTVL

XENP13707 H1.85_L1.54

SEQ ID NO:713

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTACYYCVRHGNFGDSYVSWFAYWGQGTLVTVSSGGGGSGGGGSGGGGS
QAVVTQEPSLTVSPGGTVTLTCGSSTGAVTTSNYANWVQQKPGCSPRGLIGGTNKRAPGVPARFSGSLLG
GKAALTISGAQPEDEADYYCALWYSNHWVFGGGTKLTVLGSHHHHHH

SEQ ID NO:714

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTACYYCVRHGNFGDSYVSWFAYWGQGTLVTVSSGGGGSGGGGSGGGGS
QAVVTQEPSLTVSPGGTVTLTCGSSTGAVTTSNYANWVQQKPGCSPRGLIGGTNKRAPGVPARFSGSLLG
GKAALTISGAQPEDEADYYCALWYSNHWVFGGGTKLTVL

SEQ ID NO:715

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTACYYCVRHGNFGDSYVSWFAYWGQGTLVTVSS

SEQ ID NO:716

QAVVTQEPSLTVSPGGTVTLTCGSSTGAVTTSNYANWVQQKPGCSPRGLIGGTNKRAPGVPARFSGSLLG
GKAALTISGAQPEDEADYYCALWYSNHWVFGGGTKLTVL

XENP13708 H1.86_L1.55

SEQ ID NO:717

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYCSWFAYWGQGTLVTVSSGGGGSGGGGSGGGGS
QAVVTQEPSLTVSPGGTVTLTCGSSTGAVTTSNYANWVQQKPGKSPRGLIGGTNCRAPGVPARFSGSLLG
GKAALTISGAQPEDEADYYCALWYSNHWVFGGGTKLTVLGSHHHHHH

Figure 62F

SEQ ID NO:718

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYCSWFAYWGQGTLVTVSSGGGGSGGGGSGGGGS
QAVVTQEPSLTVSPGGTVTLTCGSSTGAVTTSNYANWVQQKPGKSPRGLIGGTNCRAPGVPARFSGSLLG
GKAALTISGAQPEDEADYYCALWYSNHWVFGGGTKLTVL

SEQ ID NO:719

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYCSWFAYWGQGTLVTVSS

SEQ ID NO:720

QAVVTQEPSLTVSPGGTVTLTCGSSTGAVTTSNYANWVQQKPGKSPRGLIGGTNCRAPGVPARFSGSLLG
GKAALTISGAQPEDEADYYCALWYSNHWVFGGGTKLTVL

XENP13709 H1.83_L1.56

SEQ ID NO:721

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFCYWGQGTLVTVSSGGGGSGGGGSGGGGS
QAVVTQEPSLTVSPGGTVTLTCGSSTGAVTTSNYANWVQQKPGKSPRGLIGGTNKRCPGVPARFSGSLLG
GKAALTISGAQPEDEADYYCALWYSNHWVFGGGTKLTVLGSHHHHHH

SEQ ID NO:722

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFCYWGQGTLVTVSSGGGGSGGGGSGGGGS
QAVVTQEPSLTVSPGGTVTLTCGSSTGAVTTSNYANWVQQKPGKSPRGLIGGTNKRCPGVPARFSGSLLG
GKAALTISGAQPEDEADYYCALWYSNHWVFGGGTKLTVL

SEQ ID NO:723

EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFCYWGQGTLVTVSS

SEQ ID NO:724

QAVVTQEPSLTVSPGGTVTLTCGSSTGAVTTSNYANWVQQKPGKSPRGLIGGTNKRCPGVPARFSGSLLG
GKAALTISGAQPEDEADYYCALWYSNHWVFGGGTKLTVL

| XENP | VH ID | VL ID | Yield (mg/L) | $T_m$ (°C) |
|---|---|---|---|---|
| 12912 | H1.79 | L1.48 | 2.70 | 71.0 |

— US 11,053,316 B2

OPTIMIZED ANTIBODY VARIABLE REGIONS

PRIORITY CLAIM

This application is a continuation of U.S. patent application Ser. No. 14/207,489, filed Mar. 12, 2014, which claims benefit under 35 U.S.C. § 119 to U.S. Patent Application Nos. 61/778,148, filed Mar. 12, 2013; 61/778,157, filed Mar. 12, 2013; 61/818,344, filed May 1, 2013; 61/780,310, filed Mar. 13, 2013; 61/780,334, filed Mar. 13, 2013; 61/818,410, filed May 1, 2013; 61/913,832, filed Dec. 9, 2013; 61/818,153, filed May 1, 2013; 61/938,095, filed Feb. 10, 2014; 61/794,695, filed Mar. 15, 2013; 61/794,896, filed Mar. 15, 2013; 61/818,401, filed May 1, 2013 and 61/913,879, filed Dec. 9, 2013. U.S. patent application Ser. No. 14/207,489, filed Mar. 12, 2014 is also a continuation-in-part of U.S. patent application Ser. No. 14/200,652, filed Mar. 7, 2014; Ser. No. 14/155,248, filed Jan. 14, 2014; Ser. No. 14/155,334, filed Jan. 14, 2014, now U.S. Pat. No. 9,701,759; Ser. No. 14/155,344, filed Jan. 14, 2014; Ser. No. 14/205,227, filed Mar. 11, 2014; Ser. No. 14/205,248, filed Mar. 11, 2014, now U.S. Pat. No. 9,650,446; and Ser. No. 14/200,821, filed Mar. 7, 2014, now U.S. Pat. No. 9,605,084, each of which is expressly incorporated by reference in its entirety.

SEQUENCE LISTING

The instant application contains a Sequence Listing which has been submitted electronically in ASCII format and is hereby incorporated by reference in its entirety. Said ASCII copy, created on Sep. 12, 2014, is named REVISED 067461_5165_US01.txt and is 1,308,342 bytes in size.

INCORPORATION BY REFERENCE

U.S. Patent Application Nos. 61/778,148, filed Mar. 12, 2013; 61/778,157, filed Mar. 12, 2013; 61/818,344, filed May 1, 2013; 61/780,310, filed Mar. 13, 2013; 61/780,334, filed Mar. 13, 2013; 61/818,410, filed May 1, 2013; 61/913,832, filed Dec. 9, 2013; 61/818,153, filed May 1, 2013; 61/938,095, filed Feb. 10, 2014; 61/794,695, filed Mar. 15, 2013; 61/794,896, filed Mar. 15, 2013; 61/818,401, filed May 1, 2013; 61/913,879, filed Dec. 9, 2013; Ser. No. 14/200,652, filed Mar. 7, 2014; Ser. No. 14/155,248, filed Jan. 14, 2014; Ser. No. 14/155,334, filed Jan. 14, 2014; Ser. No. 14/155,344, filed Jan. 14, 2014; Ser. No. 14/205,227, filed Mar. 11, 2014; Ser. No. 14/205,248, filed Mar. 11, 2014; and Ser. No. 14/200,821, filed Mar. 7, 2014 are all expressly incorporated by reference in their entirety, particularly for the recitation of amino acid positions and substitutions, and all data, figures and legends relating thereto.

BACKGROUND OF THE INVENTION

Antibody-based therapeutics have been used successfully to treat a variety of diseases, including cancer and autoimmune/inflammatory disorders. Yet improvements to this class of drugs are still needed, particularly with respect to enhancing their clinical efficacy. One avenue being explored is the engineering of additional and novel antigen binding sites into antibody-based drugs such that a single immunoglobulin molecule co-engages two different antigens. Such non-native or alternate antibody formats that engage two different antigens are often referred to as bispecifics. Because the considerable diversity of the antibody variable region (Fv) makes it possible to produce an Fv that recognizes virtually any molecule, the typical approach to bispecific generation is the introduction of new variable regions into the antibody.

A number of alternate antibody formats have been explored for bispecific targeting (Chames & Baty, 2009, mAbs 1[6]:1-9; Holliger & Hudson, 2005, Nature Biotechnology 23[9]:1126-1136; Kontermann, mAbs 4(2):182 (2012), all of which are expressly incorporated herein by reference). Initially, bispecific antibodies were made by fusing two cell lines that each produced a single monoclonal antibody (Milstein et al., 1983, Nature 305:537-540). Although the resulting hybrid hybridoma or quadroma did produce bispecific antibodies, they were only a minor population, and extensive purification was required to isolate the desired antibody. An engineering solution to this was the use of antibody fragments to make bispecifics. Because such fragments lack the complex quaternary structure of a full length antibody, variable light and heavy chains can be linked in single genetic constructs. Antibody fragments of many different forms have been generated, including diabodies, single chain diabodies, tandem scFv's, and Fab2 bispecifics (Chames & Baty, 2009, mAbs 1[6]:1-9; Holliger & Hudson, 2005, Nature Biotechnology 23[9]:1126-1136; expressly incorporated herein by reference). While these formats can be expressed at high levels in bacteria and may have favorable penetration benefits due to their small size, they clear rapidly in vivo and can present manufacturing obstacles related to their production and stability. A principal cause of these drawbacks is that antibody fragments typically lack the constant region of the antibody with its associated functional properties, including larger size, high stability, and binding to various Fc receptors and ligands that maintain long half-life in serum (i.e. the neonatal Fc receptor FcRn) or serve as binding sites for purification (i.e. protein A and protein G).

More recent work has attempted to address the shortcomings of fragment-based bispecifics by engineering dual binding into full length antibody-like formats (Wu et al., 2007, Nature Biotechnology 25[11]:1290-1297; U.S. Ser. No. 12/477,711; Michaelson et al., 2009, mAbs 1[2]:128-141; PCT/US2008/074693; Zuo et al., 2000, Protein Engineering 13[5]:361-367; U.S. Pat. No. 9,865,198; Shen et al., 2006, J Biol Chem 281[16]:10706-10714; Lu et al., 2005, J Biol Chem 280[20]:19665-19672; PCT/US2005/025472; expressly incorporated herein by reference). These formats overcome some of the obstacles of the antibody fragment bispecifics, principally because they contain an Fc region. One significant drawback of these formats is that, because they build new antigen binding sites on top of the homodimeric constant chains, binding to the new antigen is always bivalent.

For many antigens that are attractive as co-targets in a therapeutic bispecific format, the desired binding is monovalent rather than bivalent. For many immune receptors, cellular activation is accomplished by cross-linking of a monovalent binding interaction. The mechanism of cross-linking is typically mediated by antibody/antigen immune complexes, or via effector cell to target cell engagement. For example, the low affinity Fc gamma receptors (FcγRs) such as FcγRIIa, FcγRIIb, and FcγRIIIa bind monovalently to the antibody Fc region. Monovalent binding does not activate cells expressing these FcγRs; however, upon immune complexation or cell-to-cell contact, receptors are cross-linked and clustered on the cell surface, leading to activation. For receptors responsible for mediating cellular killing, for example FcγRIIIa on natural killer (NK) cells, receptor cross-linking and cellular activation occurs when the effector cell engages the target cell in a highly avid format (Bowles & Weiner, 2005, J Immunol Methods 304:88-99, expressly incorporated by reference). Similarly, on B cells the inhibitory receptor FcγRIIb downregulates B cell activation only when it engages into an immune complex with the cell surface B-cell receptor (BCR), a mechanism that is mediated by immune complexation of soluble IgG's with the same antigen that is recognized by the BCR (Heyman 2003, Immunol Lett 88[2]:157-161; Smith and Clatworthy, 2010, Nature Reviews Immunology 10:328-343; expressly incorporated by reference). As another example, CD3 activation of T-cells occurs only when its associated T-cell receptor (TCR) engages antigen-loaded MHC on antigen presenting cells in a highly avid cell-to-cell synapse (Kuhns et al., 2006, Immunity 24:133-139). Indeed, nonspecific bivalent cross-linking of CD3 using an anti-CD3 antibody elicits a cytokine storm and toxicity (Perruche et al., 2009, J Immunol 183 [2]:953-61; Chatenoud & Bluestone, 2007, Nature Reviews Immunology 7:622-632; expressly incorporated by reference). Thus for practical clinical use, the preferred mode of CD3 co-engagement for redirected killing of targets cells is monovalent binding that results in activation only upon engagement with the co-engaged target. Furthermore, because of the potential for undesired CD3-mediated toxicities, there is a need in the art for anti-CD3 antibodies and derivatives that cross-react with primate CD3 antigen for use in preclinical toxicology studies.

There are a number of multispecific antibody or antibody-fragment formats that are in development, relying on one binding site binding to CD3. These include bispecific binding moieties discussed in US 20110262439, for example. The present invention provides a number of optimized anti-CD3 variable sequences that can be used in bispecific formats, including formats relying on scFv formats, scFv-Fc fusions, and the like.

BRIEF SUMMARY OF THE INVENTION

The present invention is directed to optimized anti-CD3 variable sequences for use in a variety of bispecific formats, including those that utilize scFv components. The invention further relates to nucleic acids encoding for the polypeptide, to vectors comprising the same and to host cells comprising the vector. In another aspect, the invention provides for a pharmaceutical composition comprising the mentioned polypeptide and medical uses of the polypeptide.

Accordingly, the present invention provides compositions comprising an anti-CD3 variable region having a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430. In some cases, the variable heavy domain of the composition does not have the sequence depicted in SEQ ID NO:1 and the variable light domain of the composition does not have the sequence depicted in SEQ ID NO:2.

In further aspects, the anti-CD3 variable region is an scFv with a sequence selected from the group consisting of SEQ ID NOs: 4, 8, 16, 20, 32, 40, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 292, 296, 300, 304, 308, 312, 316, 320, 324, 328, 332, 336, 340, 344, 348, 352, 356, 360, 364, 368, 372, 376, 380, 384, 388, 392, 396, 400, 404, 408.

In an additional aspect, the compositions of the invention further comprise an Fc region, including dual scFv-Fc, with a first anti-CD30 scFV and a second scFv. In some aspects, the second scFv binds to a target antigen selected from the group consisting of CD5, CD20, CD30, CD33, CD38, CD40, EGFR, EpCAM, Her2, HM1.24.

In a further aspect, the anti-CD3 variable region comprises a variable heavy region comprising a sequence selected from the group consisting of SEQ ID NOs: 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393, 397, 401, 405, 409.

In a further aspect, the anti-CD3 variable region comprises a variable light region comprising a sequence selected from the group consisting of SEQ ID NOs: 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214, 218, 222, 226, 230, 234, 238, 242, 246, 250, 254, 258, 262, 266, 270, 274, 278, 282, 286, 290, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410.

In an additional aspect, the composition is a bispecific IgG, the anti-CD30 variable region is a first scFv and said composition comprises a second scFv.

In a further aspect, the composition is a MAb-Fv, wherein the variable heavy domain of the anti-CD30 variable region is attached to a first heavy chain of the mAb-Fv and the variable light chain of the anti-CD30 variable region is attached to a second heavy chain of the mAb-Fv.

In an additional aspect, the composition is a multi-scFv.
In an additional aspect, the composition is an-scFv-CH3.
In an additional aspect, the composition is a mAb-scFv.
In an additional aspect, the composition is a mAb-scFv2.
In an additional aspect, the composition is a full-length antibody.

In a further aspect, the composition comprises an Fc domain and comprises an amino acid substitution. In some aspects, the Fc domain has altered binding to a FcγR receptor, including FcγRIIIa and/or FcγRIIb. In this embodiment, if the altered binding is to FcγRIIIa, the said amino acid substitution is selected from the group consisting of 239D, 239E, 236R, 330L, 332D, 332E, 239D/332E, 239D/332E/330L, 267D, 267E, 328F, 328R, 267E/328F, 243L 298A and 236R/328R.

In some aspects, the composition comprises an Fc domain with altered binding to a FcRn receptor, and comprises an amino acid substitution is selected from the group consisting of 434A, 434S, 428L, 308F, 259I, 428L/434S, 259I/308F, 436I/428L, 436I or V/434S, 436V/428L, 252Y, 252Y/254T/256E and 259I/308F/428L.

In a further aspect, the composition has a structure selected from the group consisting of FIG. 7A-7M, FIGS. 8B and 8D, FIG. 9B, FIGS. 10A-10E and FIGS. 11A-E, wherein the Fc domain of said structure comprises a set of corresponding variants selected from FIG. 12. In other aspects, the composition has a structure selected from the group consisting of FIG. 7A-7M, FIGS. 8B and 8D, FIG. 9B, FIGS. 10A-10E and FIGS. 11A-E, wherein the Fc domain of the structure comprises a set of corresponding variants selected from FIG. 13. In other aspects, the composition has a a structure selected from the group consisting of FIG. 7A-7M, FIGS. 8B and 8D, FIG. 9B, FIGS. 10A-10E and FIGS. 11A-E, wherein the Fc domain of the structure comprises a set of corresponding variants selected from FIG. 14.

BRIEF DESCRIPTION OF THE DRAWINGS

FIG. 1A-1C. Stability-optimized, humanized anti-CD3 variant scFvs. Substitutions are given relative to the H1_L1.4 scFv sequence. Amino acid numbering is Kabat numbering.

FIG. 2A-2YY. Amino acid sequences of stability-optimized, humanized anti-CD3 variant scFvs, variable heavy and variable light sequences. (Note also that the first sequence is the histidine tagged version for ease of purification). CDRs are underlined. It should be understood that the increased stability of the optimized variable and optimized light chains (as well as the scFv chains) can be attributed to framework regions as well as the CDRs. Thus, it should be understood that the disclosure of the entire variable region includes the disclosure of the framework regions, although they are not separately numbered.

FIG. 3A-3B. Yields after Ni-NTA purification and melting temperatures ($T_m$) as determined by DSF (Differential Scanning Fluorimetry) of stability-optimized, humanized anti-CD3 variant scFvs.

FIG. 4A-4B. Fold improvement (relative to H1_L1.4 scFv) in cell surface binding affinities ($IC_{50}$) of stability-optimized, humanized anti-CD3 variant scFvs as determined in a competitive binding experiment using purified human T cells from PBMCs.

FIG. 5. Amino acid sequences that can be used as linkers in scFvs and scFv-containing constructs.

FIG. 6 is the sequence of human CD3.

FIG. 7A-7U depicts a wide variety of the multispecific (e.g. heterodimerization) formats in which the optimized anti-CD3 variable regions find use. As a preliminary matter, the structures of FIG. 7A-7U all show a fusion partner of a variable region (including scFvs). However, as described herein for fusion proteins, other binding ligands can take the place of these variable regions, while one remains CD3 specific. FIG. 7A shows a dual scFv-Fc format, that, as for all heterodimerization formats herein (e.g. everything except the IgG antibody of FIG. 8C) can include heterodimerization variants such as pI variants, knobs in holes (KIH, also referred to herein as steric variants), charge pairs (a subset of steric variants), and SEED body ("strand-exchange engineered domain"; see Klein et al., mAbs 4:6 653-663 (2012) and Davis et al, Protein Eng Des Sel 2010 23:195-202) which rely on the fact that the CH3 domains of human IgG and IgA do not bind to each other. As for all the heterodimeric structures herein, these heterodimerization variants can be combined, optionally and independently and in any combination. What is important is that the "strandedness" of the monomer pairs remains intact although variants listed as "monomer 1" variants in the steric list can be crossed with "monomer 2" variants in the pI list. That is, any set can be combined with any other, regardless of which "monomer" list to which they are associated. FIG. 7B depicts a bispecific IgG, again with the option of a variety of heterodimerization variants. FIG. 7M shows the "CrossMab" structure, where the problem of multiplex formation due to two different light chains is addressed by switching sequences in the Fab portion. FIG. 7N depicts an scFv, FIG. 7O is a "BiTE" or scFv-scFv linked by a linker as outlined herein, FIG. 7P depicts a DART, FIG. 7Q depicts a TandAb, and FIG. 7R shows a diabody. FIGS. 7S, 7T and 7U depict additional alternative scaffold formats that find use in the present invention.

FIG. 9A shows a scFv-Fc format, which also finds use in the present invention with the pI variants of the invention, as described below (and optionally and independently the other heterodimerization variants). FIG. 9C depicts a more standard bispecific format, also utilizing the pI variants of the invention (and optionally and independently the other heterodimerization variants). FIG. 9B shows the "triple F" format (sometimes also referred to as the "bottle-opener" configuration; (and optionally and independently the other heterodimerization variants).

FIG. 10A shows a "triple F" configuration with another scFv attached to the Fab monomer (this one, along with FIG. 10D, has a greater molecular weight differential as well). FIG. 10B depicts a "triple F" with another scFv attached to the scFv monomer. FIG. 10C depicts a "three scFv" format. FIG. 10D depicts an additional Fab attached to the Fab monomer. FIG. 10E depicts a Fab hooked to one of the scFv monomers.

FIG. 11A shows a "Fab-Fv" format with binding to two different antigens, with FIG. 11B depicting the "Fab-Fv" format with binding to a single antigen (e.g. bivalent binding to antigen 1). FIGS. 11C and 11D depicts a "Fv-Fab" format with similar bivalent or monovalent additional antigen binding. FIG. 11E depicts one monomer with a CH1-CL attached to the second scFv.

FIGS. 12A and 12B show novel steric variants. As will be understood by those in the art, the first column of each table represents "corresponding" monomer pairs or "sets": that is, monomer 1 has 405A and the corresponding steric variant is 394F.

FIG. 13A-13B depicts heterodimerization variants that find particular use in the present invention.

FIG. 14 depicts novel pI heterodimerization variants of particular use in the creation of heterodimeric proteins. As will be understood by those in the art, the first row of each table represents "corresponding" monomer pairs or sets. Note that the I199T and V397M variants are "neutral" (e.g. not for the purposes of altering pI of one of the monomers). Rather, they contribute to the reduction of immunogenicity by helping preserve a close epitope; e.g I199T follows pI variants N203D or Q196K, and V397M follows K392N. Thus these two variants can optionally and independently be removed from any of the sequences above.

FIG. 15 depicts a matrix of possible combinations of heterodimerization formats, heterodimerization variants (separated into pI variants and steric variants (which includes charge pair variants), Fc variants, FcRn variants and combinations. Legend A are suitable FcRn variants: 434A, 434S, 428L, 308F, 259I, 428L/434S, 259I/308F, 436I/428L, 436I or V/434S, 436V/428L, 252Y, 252Y/254T/256E and 259I/308F/428L. That is, the dual scFv-Fc format of FIG. 7A can have any of these FcRn variants. For clarity, as each heavy chain is different, FcRn variants (as well as the Fc variants) can reside on one or both monomers. Legend B are suitable Fc variants: 236A, 239D, 239E, 243L, 243A, 332E, 332D, 239D/332E, 267D, 267E, 328F, 267E/328F, 236A/332E, 239D/332E/330Y, 239D, 332E/330L, 236R, 328R, 236R/328R, 236N/267E, 264V, 264A and 299T. (Note, additional suitable Fc variants are found in FIG. 41 of US 2006/0024298, the figure and legend of which are hereby incorporated by reference in their entirety). Legend C are suitable pI variants, and these, for brevity are imported from FIG. 14, again with the understanding that there is a "strandedness" to pI variants. Legend D are suitable steric variants (including charge pair variants); again, for brevity are imported from FIG. 12A-12B, again with the understanding that there is a "strandedness" to steric variants. Legend E reflects the following possible combinations, again, with each variant being independently and optionally combined from the appropriate source Legend: 1) pI variants plus FcRn variants; 2) pI variants plus Fc variants; 3) pI variants plus FcRn variants plus Fc variants; 4) steric variants plus FcRn variants; 5) steric variants plus Fc variants; 6) steric variants plus FcRn variants plus Fc variants; 7) pI variants plus steric variants plus FcRn variants; 8) pI variants plus steric variants plus Fc variants; 9) pI variants plus steric variants plus FcRn variants plus Fc variants; and 10) pI variants plus steric variants.

FIG. 17A-17I depicts a collation of all the vhCDR1-3 and vlCDR1-3 sequences useful in the present invention.

FIG. 18A-18C depicts a number of pI variants that can additionally find use in the present invention, which is a list of all possible reduced pI variants created from isotypic substitutions of IgG1-4. Shown are the pI values for the three expected species as well as the average delta pI between the heterodimer and the two homodimer species present when the variant heavy chain is transfected with IgG1-WT heavy chain.

FIG. 19 List of all possible increased pI variants created from isotypic substitutions of IgG1-4. Shown are the pI values for the three expected species as well as the average delta pI between the heterodimer and the two homodimer species present when the variant heavy chain is transfected with IgG1-WT heavy chain.

FIG. 20 depicts a list of positive and negatively charged scFv linkers of use in bispecific formats that utilize scFvs.

FIG. 21A-21B. An additional list of potential heterodimerization variants for use in the present invention, optionally and independently combined with any variants.

FIG. 22 shows some particular framework regions that confer particular stability, that can be optionally and independently combined with other framework and CDR regions.

FIG. 23A-23C depicts additional steric (e.g. including charge variants and "skewing" variants, as "monomer 1" and "monomer 2". The figure depicts these additional variants in the context of ISO(−) monomer 1 and ISO(+RR) monomer 2, although this is optional.

FIG. 24A-24B The Tm and change in Tm for stability-optimized, humanized anti-CD19 variant scFvs. Amino acid numbering is Kabat numbering. FIG. 1A as determined by DSF (Differential Scanning Fluorimetry) of stability-optimized, humanized anti-CD19 variant scFvs.done at a concentration of 0.2 mg/ml and FIG. 1B was done at 0.4 mg/ml.

FIGS. 25A-25K. Amino acid sequences of stability-optimized, humanized anti-CD19 variant scFvs, variable heavy and variable light sequences. (Note also that the first sequence is the histidine tagged version for ease of purification). It should be understood that the increased stability of the optimized variable and optimized light chains (as well as the scFv chains) can be attributed to framework regions as well as the CDRs. Thus, it should be understood that the disclosure of the entire variable region includes the disclosure of the framework regions, although they are not separately numbered. In addition, the CDRs are underlined, with those shown in yellow depicting a difference from the starting 4G7 murine CDRs. Furthermore, the linkers for the scFvs are underlined in grey, and can be exchanged optionally and independently with any charged linker listed in FIG. 20.

FIG. 26. Depicts stabilized anti-CD19 Fv regions.

FIGS. 27A and 27B depicts dual-scFv constructs (e.g. as shown in FIG. 7A).

FIGS. 28A and 28B depict "bottle opener" constructs (e.g. as shown in FIG. 9B).

FIG. 40 depicts the scheme for the "plug and play platform" for the triple F format for oncology. A Fab from any existing mAb can be combined with the anti-CD3 scFv-Fc bispecific format.

FIG. 41A shows the an anti-CD38 Fab with the anti-CD3 scFv into the triple F format, and FIG. 41B shows the Her2/CD3 combination.

FIG. 44 depicts a number of constructs incorporating engineered disulfides into anti-CD3 variable heavy and light chains.

FIG. 46 List of anti-CD3 and anti-CD19 scFvs containing positively and negatively charged linkers. Also shown are DSF Tm values.

FIG. 53A-53O. Sequences of the invention. The optional His(6) tags are underlined, and the uncharged scFv linkers are double underlined as well; if the linker is uncharged, as described herein, it can be optionally and independently swapped out with a charged linker, such as those linkers shown in FIG. 20. While the sequences depicted herein are shown with CD3 and Cd19 antigen binding domains (e.g. variable heavy and variable light chains), other variable heavy and light chains can be used, directed to any of the target antigens listed herein.

FIG. 54 depicts a variety of ablation variants, all of which can be independently and optionally incorporated into the Fc domains of the invention. It should be noted that either or both Fc domains (e.g. either one or both monomers) can contain any of the listed ablation variants.

FIG. 55 shows a list of isotypic and isosteric variant antibody constant regions and their respective substitutions. pI_(−) indicates lower pI variants, while pI_(+) indicates higher pI variants.

FIG. 56. List of bevacizumab, Fc-only, and anti-CD19× CD3 heterodimers containing isosteric pI substitutions. pI values of each expected protein species are indicated.

FIG. 60. List of bevacizumab and Fc-only variants containing isosteric pI substitutions as well as Tm values obtained from DSF.

FIG. 61A to 61K. Sequences of the invention utilizing isosteric heterodimerization variants.

FIGS. 62A-62F depict the sequences of a number of disulfide constructs; the first sequence is the scFv construct including the His(6) tag for convenience of purification, the sequence sequence is the scFv construct without the tag, the third sequence is the variable heavy chain alone and the fourth sequence is the variable light sequence alone. The CDRs are underlined, and the scFv linkers are highlighted in grey; although as described herein, these linkers can independently and optionally be swapped with any of the charged scFv linkers described herein, such as those of FIG. 20.

DETAILED DESCRIPTION OF THE INVENTION

Figure 37:
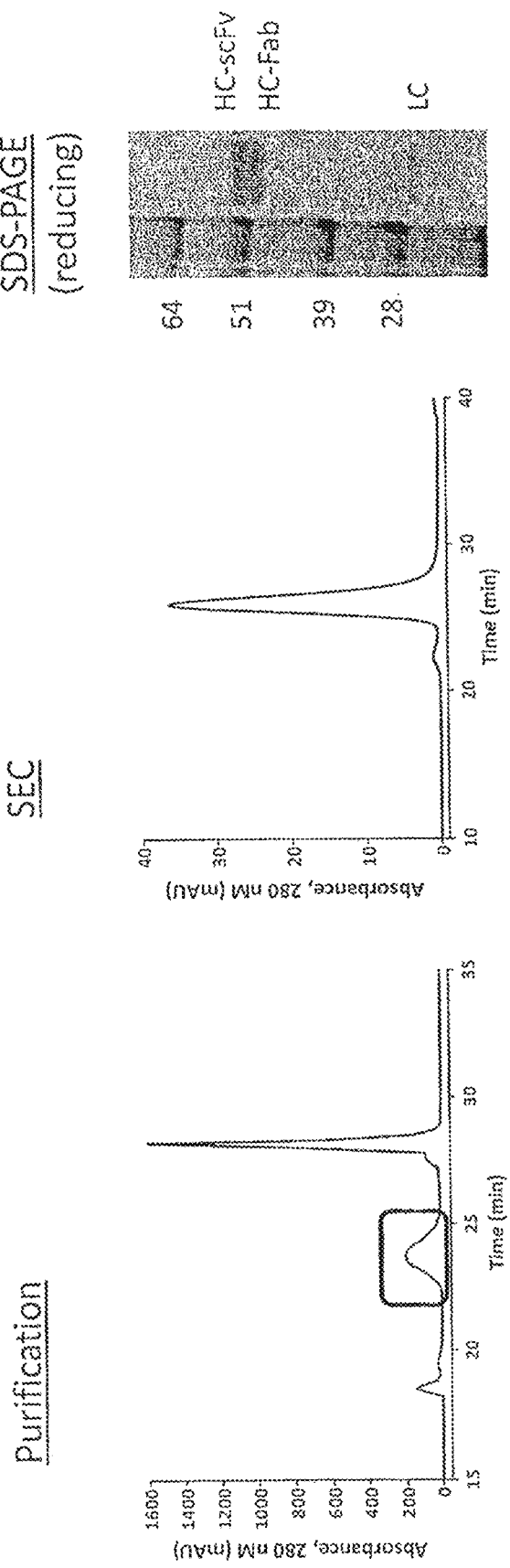
FIG. 37 shows the production and purification of the "triple F" or "bottle opener" (or as referred to in some of the figures, Fab-scFv-Fc).
Figure 38:
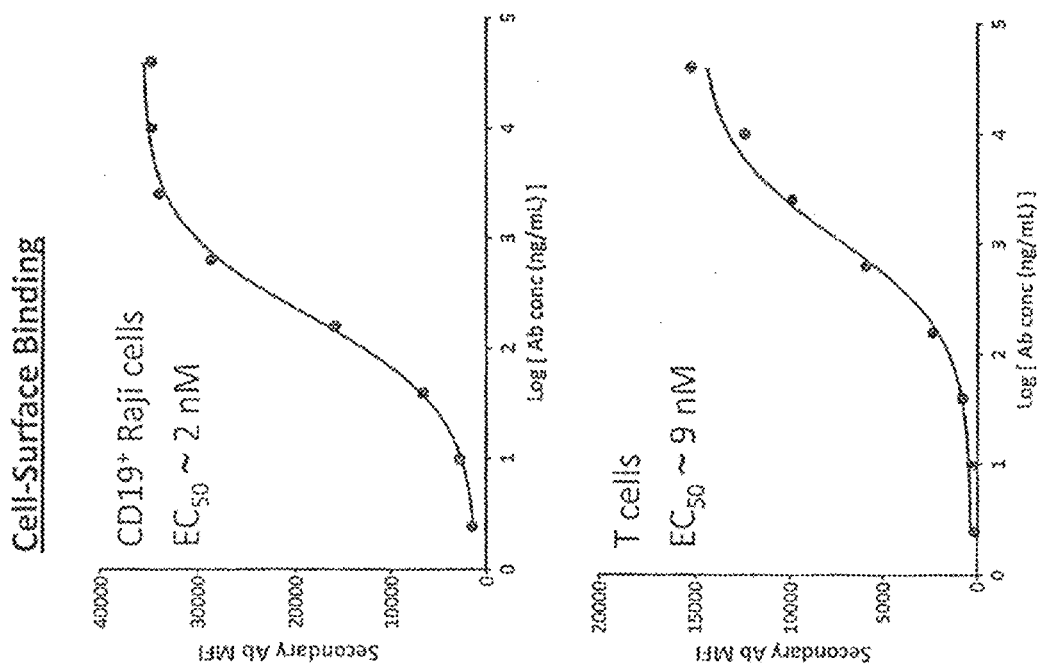
FIG. 38 shows the characterization of the anti-CD19/anti-CD3 triple F format, which exhibits picomolar cytotoxicity with only monovalent binding to the target antigens. Data generated using a fluorescent LDH RTCC assay for 24 hours. 10 k Raji cells+400 k T cells, 40:1 E:T ratio.
Figure 39:
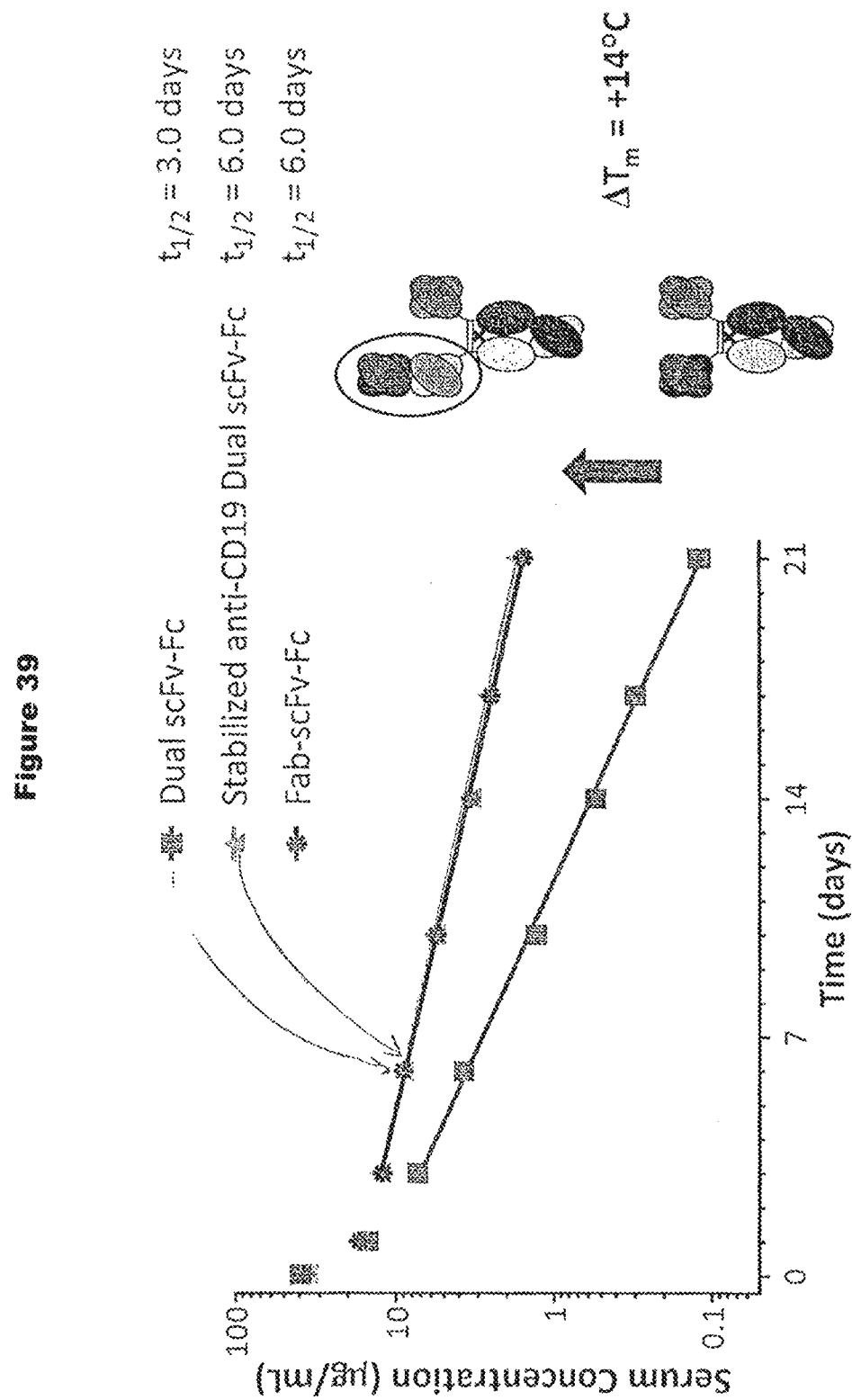
FIG. 39 shows the improvement in PK in mice that results from replacing one scFv of a dual scFv-Fc with a Fab. Replacing the anti-CD19 scFv with a Fab doubles the half-life in BL/6 mice from 3 to 6 days. BL/6 mice (n=5), 2 mg/kg IV dose. Half lives determined in Phoenix WinNonlin 6.1 by non-compartmental analysis.

FIG. 37, the variants, the legend thereof and the SEQ ID NO:s of U.S. Ser. No. 13/648,951 is hereby expressly incorporated by reference in its entirety.

I. Overview

The present invention is directed to novel constructs to provide bispecific antibodies (or, as discussed below, trispecific or tetraspecific antibodies can also be made). An ongoing problem in antibody technologies is the desire for "bispecific" (and/or multispecific) antibodies that bind to two (or more) different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B). However, a major obstacle in the formation of multispecific antibodies is the difficulty in purifying the heterodimeric antibodies away from the homodimeric antibodies and/or biasing the formation of the heterodimer over the formation of the homodimers.

The present invention is generally directed to the creation of heterodimeric proteins including antibodies, that can co-engage antigens in several ways, relying on amino acid variants in the constant regions that are different on each chain to promote heterodimeric formation and/or allow for ease of purification of heterodimers over the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" variants described below and the "charge pairs" variants described below) as well as "pI variants", which allows purification of homodimers away from heterodimers.

One mechanism is generally referred to in the art as "knobs and holes", referring to amino acid engineering that creates steric influences to favor heterodimeric formation and disfavor homodimeric formation, as described in U.S. Ser. No. 61/596,846 and U.S. Ser. No. 12/875,015, Ridgway et al., Protein Engineering 9(7):617 (1996); Atwell et al., J. Mol. Biol. 1997 270:26; U.S. Pat. No. 8,216,805, US 2012/0149876, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" or "charge pairs" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

In the present invention, in some embodiments, pI variants are used to alter the pI of one or both of the monomers and thus allowing the isoelectric purification of A-A, A-B and B-B dimeric proteins.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine).

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI (wt A-+B or wt A--B), or by increasing one region and decreasing the other region (A+-B- or A-B+).

Thus, in general, a component of some embodiments of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

Furthermore, as will be appreciated by those in the art and outlined herein, in some cases, heterodimers can be separated from homodimers on the basis of size.

By using the constant region of the heavy chain, a more modular approach to designing and purifying multispecific proteins, including antibodies, is provided. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, as, particularly in the case of CD3 antibodies, the ability to either eliminate, minimize and distinguish when homodimers are present is significant. Similarly, the ability to reliably test the reproducibility of the heterodimeric protein production is important.

In addition to all or part of a variant heavy constant domain, one or both of the monomers may contain one or two fusion partners, such that the heterodimers form multivalent proteins. For example, as shown in FIG. 64 of U.S. Ser. No. 13/648,951, hereby expressly incorporated by reference with its legend, the fusion partners can depicted as A, B, C and D, with all combinations possible. In general, A, B, C and D are selected such that the heterodimer is at least bispecific or bivalent in its ability to interact with additional proteins.

As will be appreciated by those in the art and discussed more fully below, the heterodimeric fusion proteins of the present invention can take on a wide variety of configurations, as are generally depicted in the FIG. 7A-7U. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Furthermore as is shown, these two configurations can be combined, where there can be triple or quadruple specificities based on the particular combination. Thus, the present invention provides "multispecific" binding proteins, including multispecific antibodies.

Figure 45:
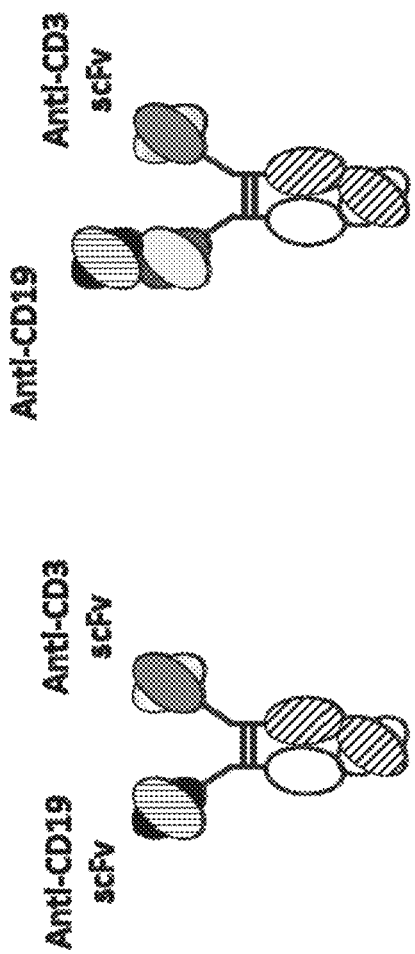
FIG. 45. Diagram showing dual-scFv and Fab-scFv-Fc bispecific antibody formats. Both formats contain at least one scFv domain whose linker can be engineered to add charged residues to enable IEX purification of the correct heterodimer species. As described herein, while depicted for anti-CD19 and anti-CD3 antigen binding domains, any suitable binding domains (e.g. for targets listed herein) can be used. The schematic on the right is the "triple F" or "bottle opener" format.
Figure 47:
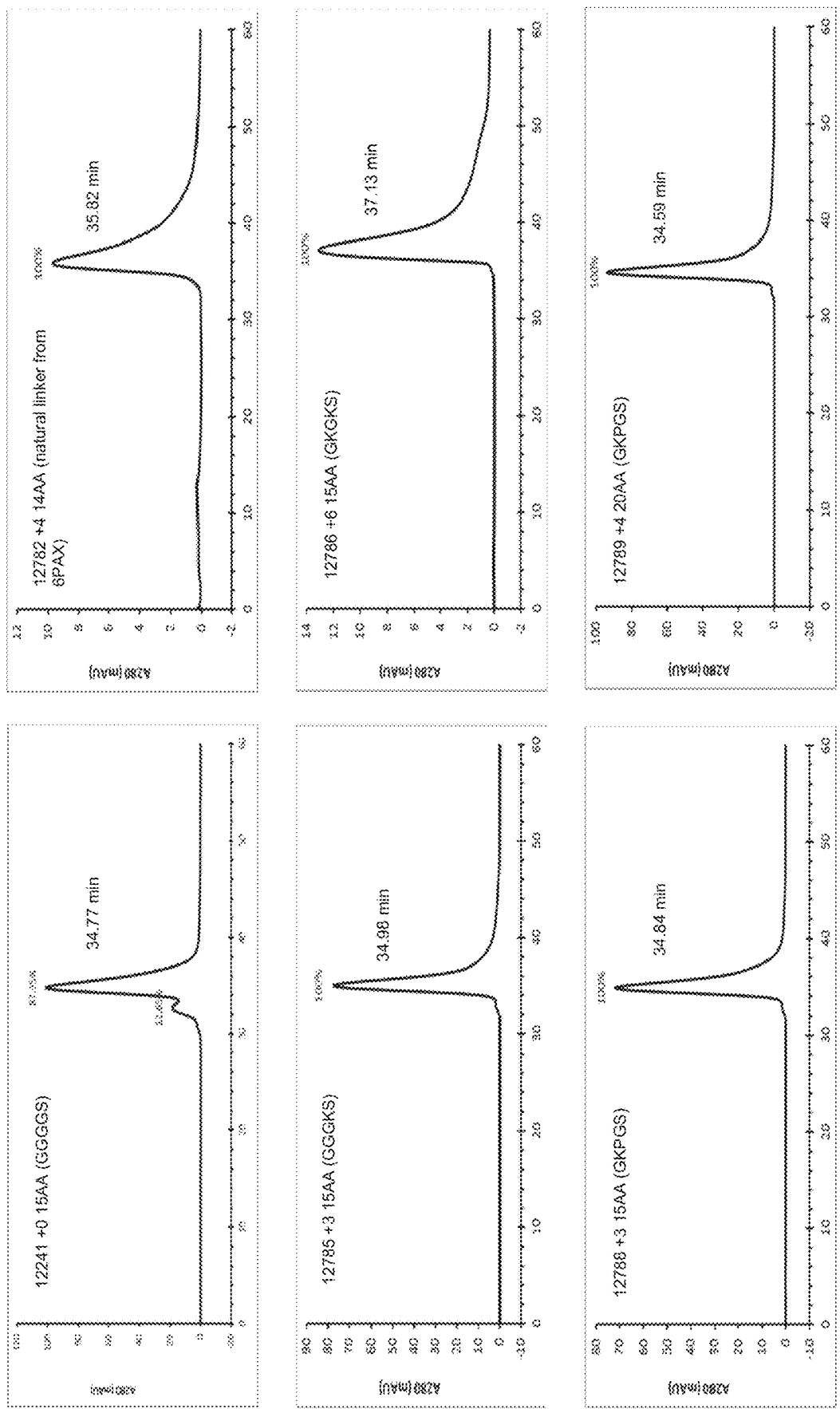
FIG. 47. Example SEC chromatograms from purified scFvs with positively charged linkers.
Figure 48:
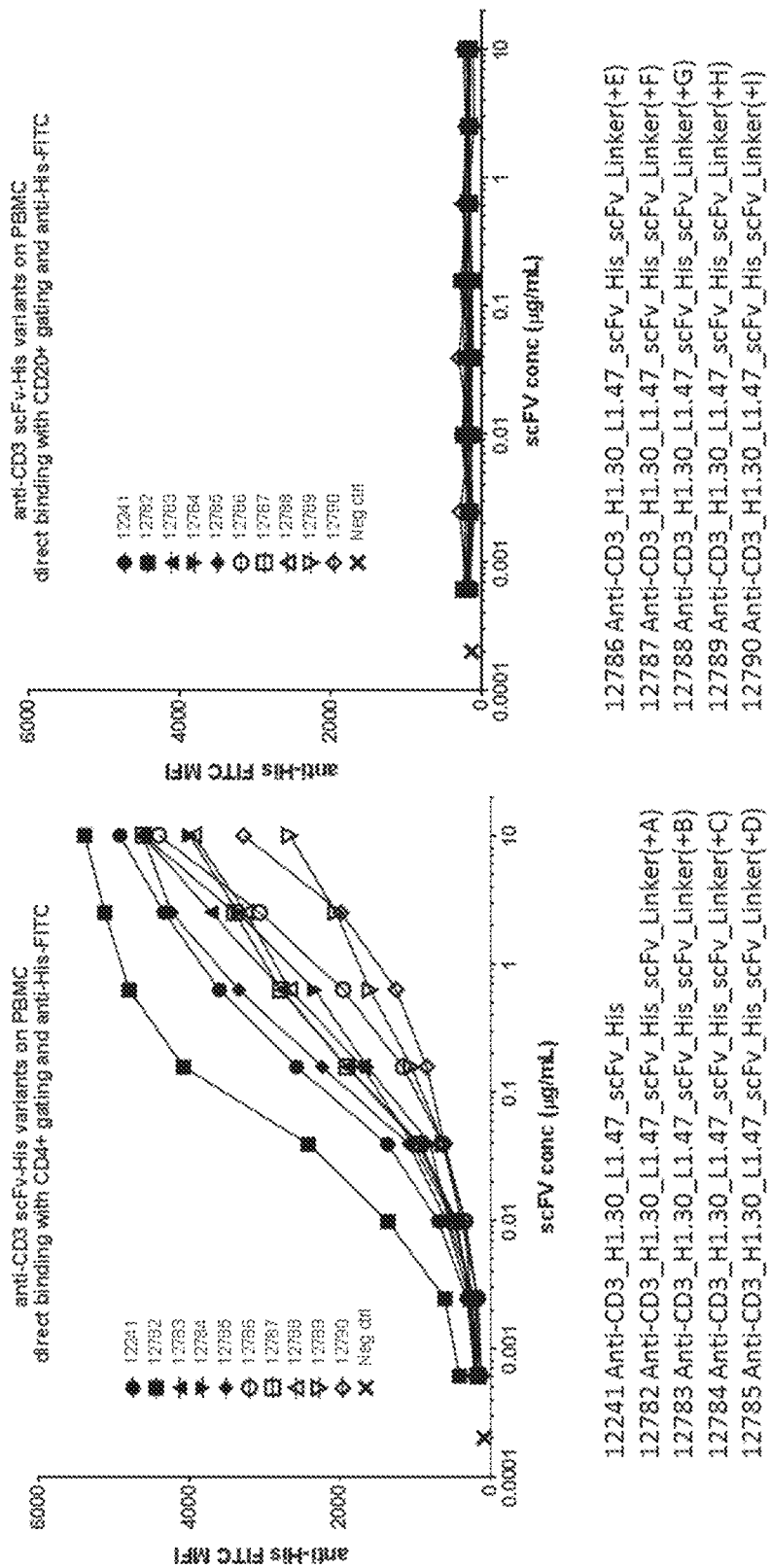
FIG. 48. Direct binding of anti-CD3 scFvs containing positively charged linkers binding to CD4+ T cells (left) or CD20+ cells from PBMCs (to check for nonspecific binding; right).
Figure 49:
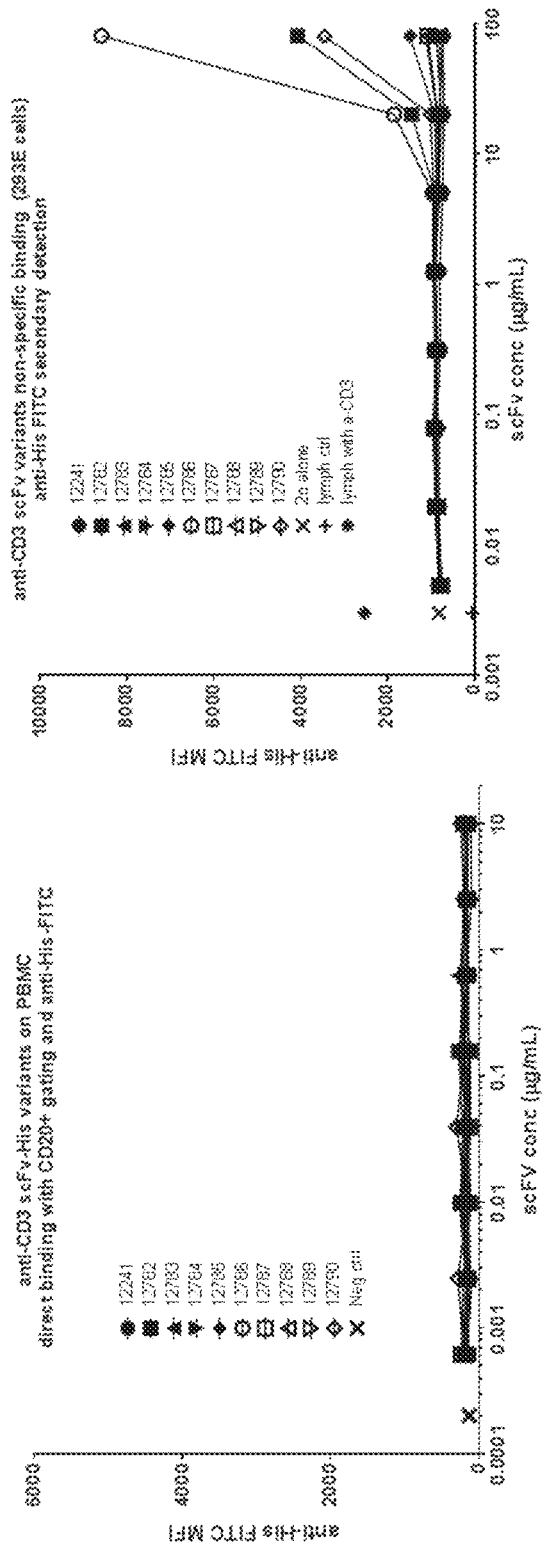
FIG. 49. Direct binding of anti-CD3 scFvs containing positively charged linkers binding to CD20+ cells from PBMCs (left) or 293E cells (right).
Figure 50:
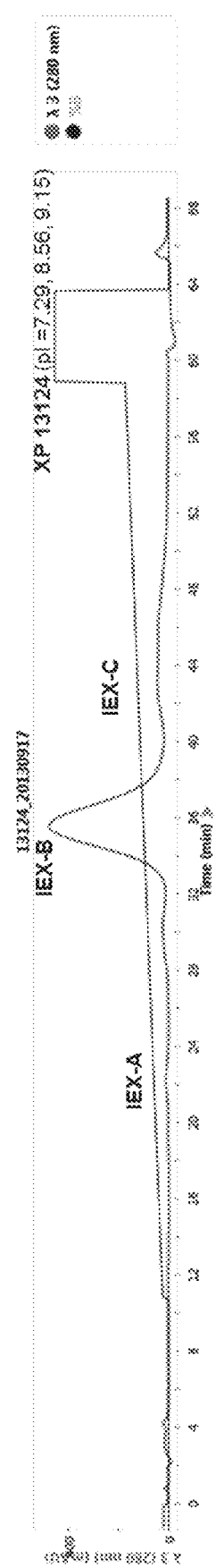
FIG. 50. Example cation exchange purification of XENP13124, which is a Fab-scFv-Fc format bispecific antibody targeting CD19 and CD3. The anti-CD3 scFv contains the positively charged linker (GKPGS)4 to enable purification.
Figure 51:
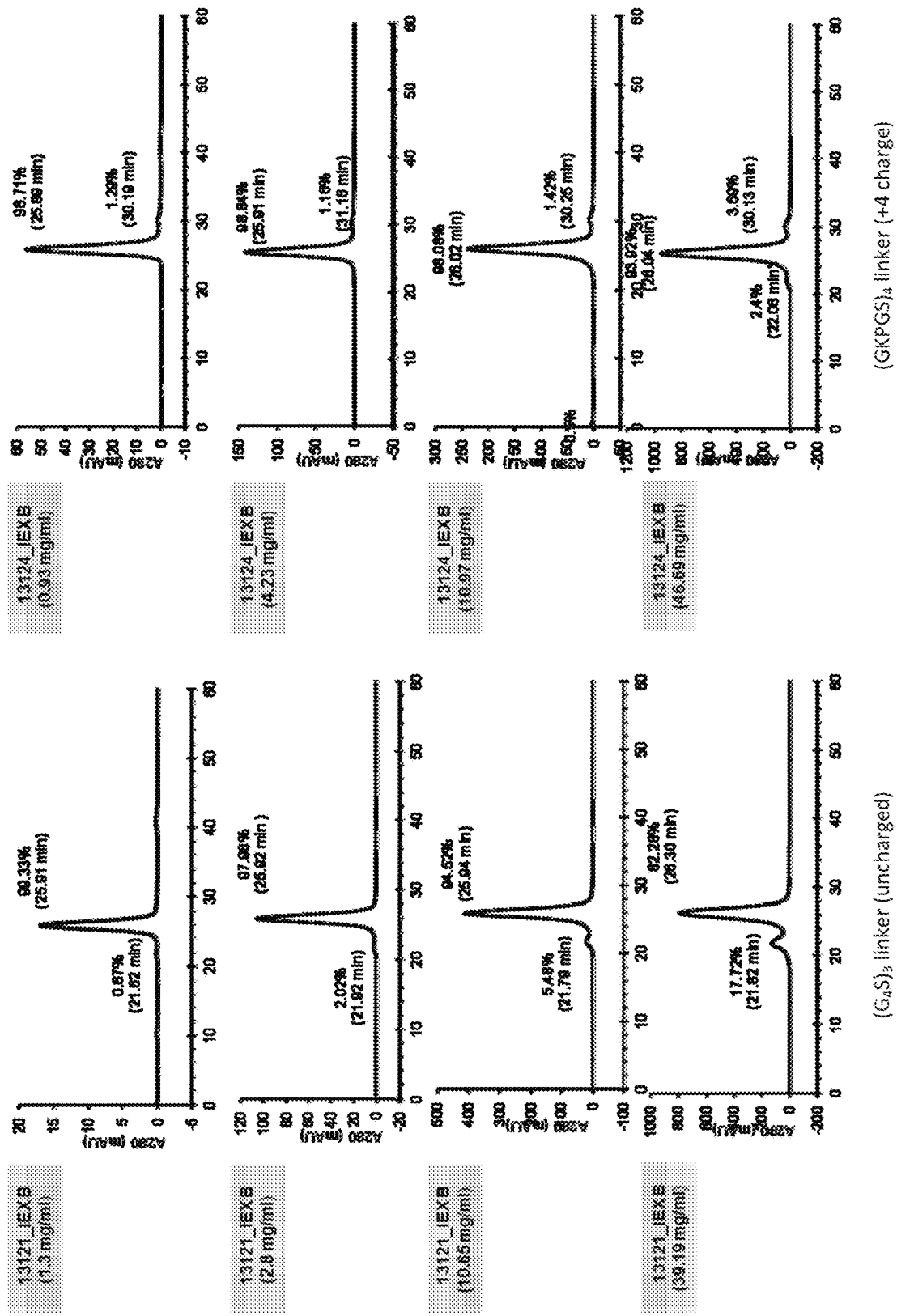
FIG. 51. Example SEC chromatograms of purified Fab-scFv-Fc format bispecific antibodies targeting CD19 and CD3 incubated at various concentrations. XENP13121 (left) contains the standard (GGGGS)4 linker while XENP13124 (right) contains the (GKPGS)4 charged linker. The charged linker has the unexpected property of decreasing the amount of high molecular aggregates present.
Figure 52:
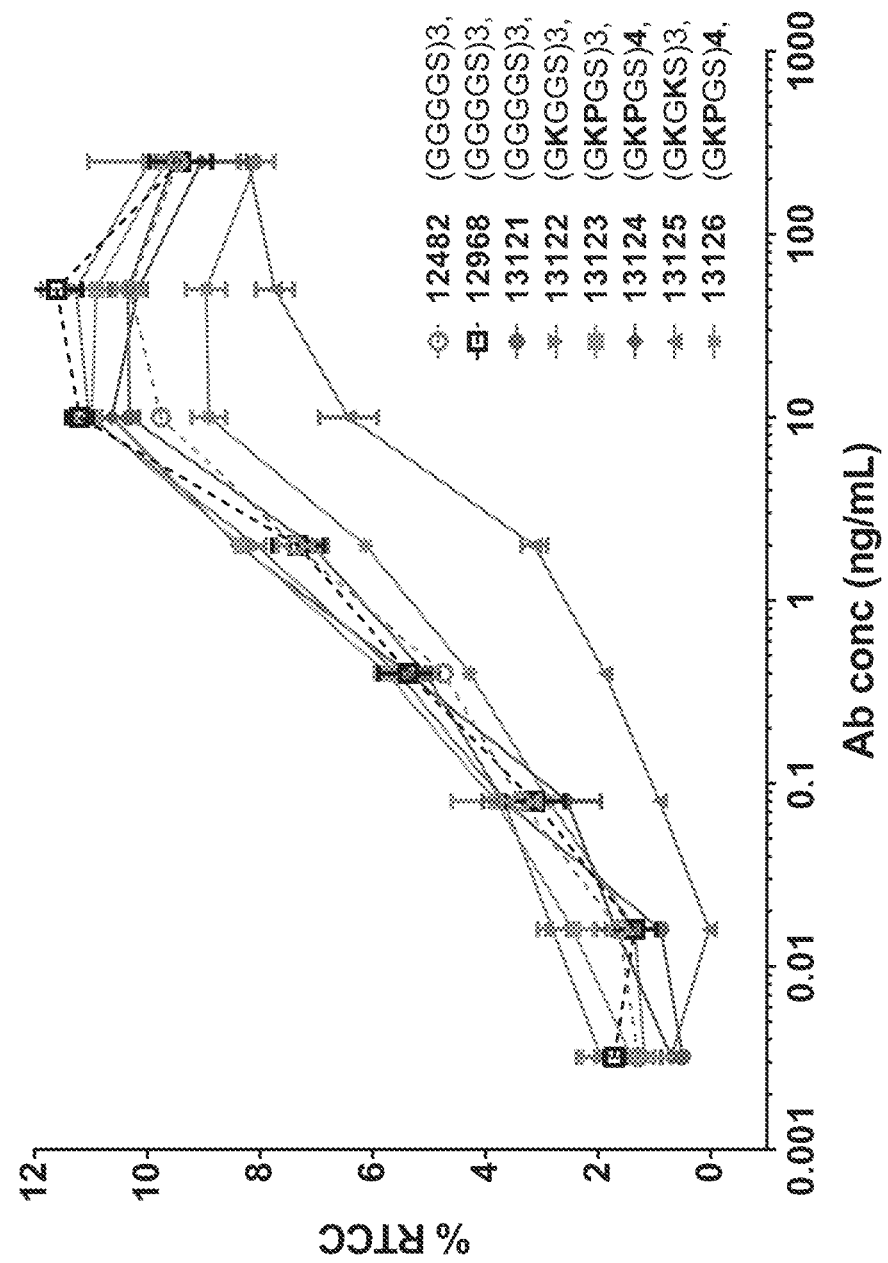
FIG. 52. RTCC assay with PBMCs and Fab-scFv-Fc format bispecific anti-CD19×CD3 antibodies containing different scFv linkers. Linkers have little impact on RTCC activity, except for the highly charged linker (GKGKS)3 which has lower activity.
Figure 57:
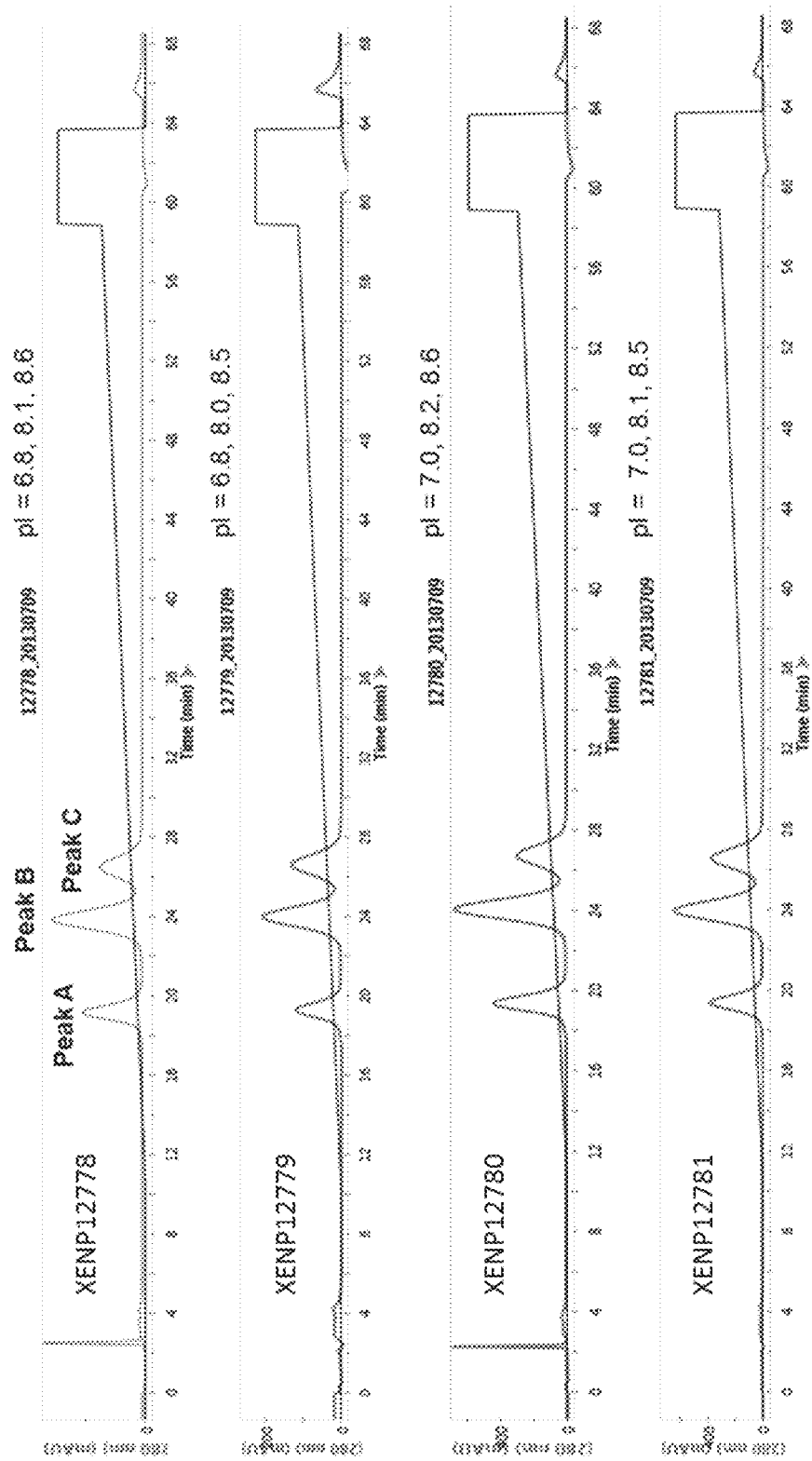
FIG. 57. Cation exchange chromatography showing purification of the heterodimer species of bevacizumab containing isosteric engineered constant regions.
Figure 58:
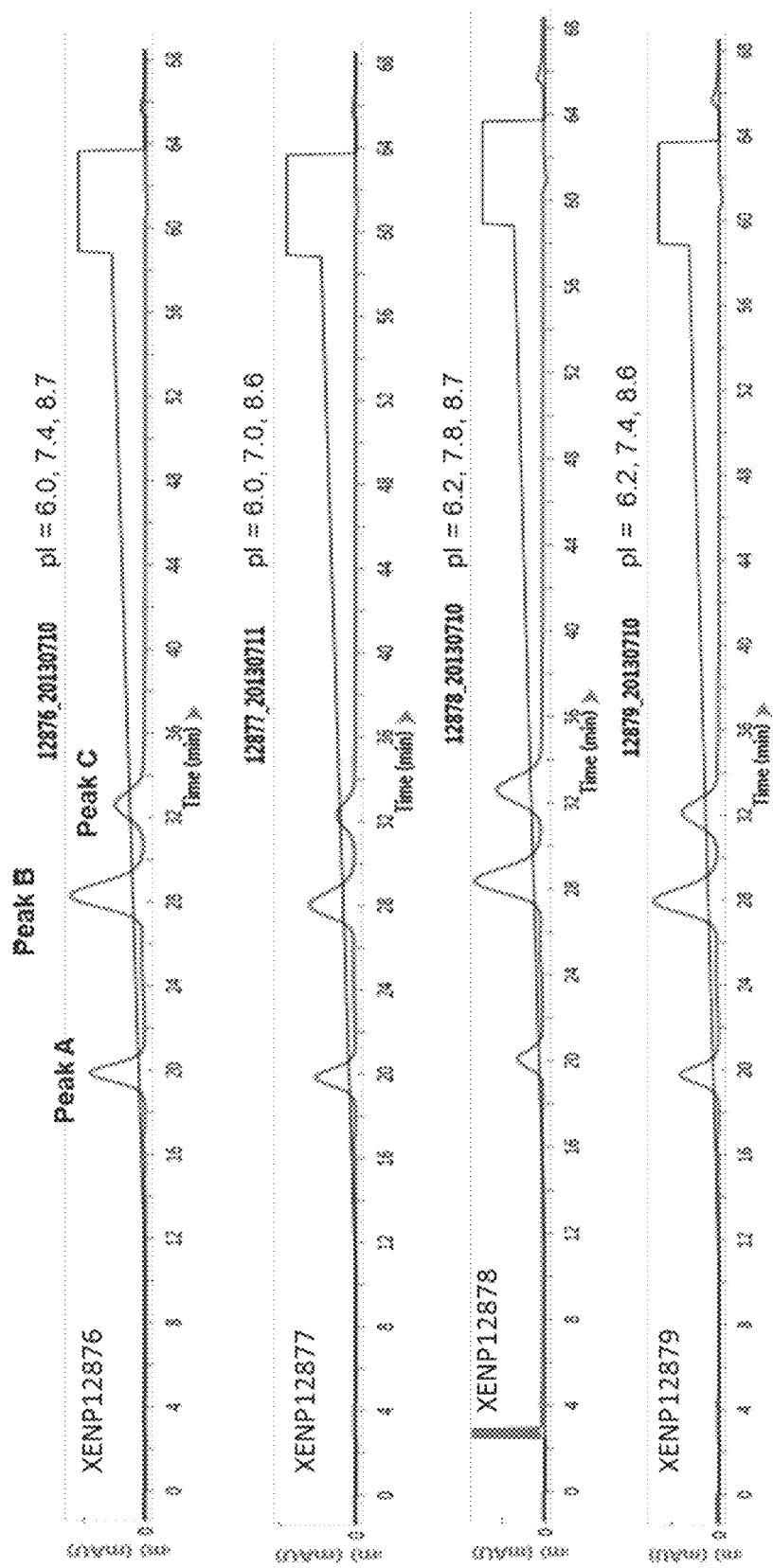
FIG. 58. Cation exchange chromatography showing purification of the heterodimer species of Fc-only variants containing isosteric engineered constant regions.
Figure 59:
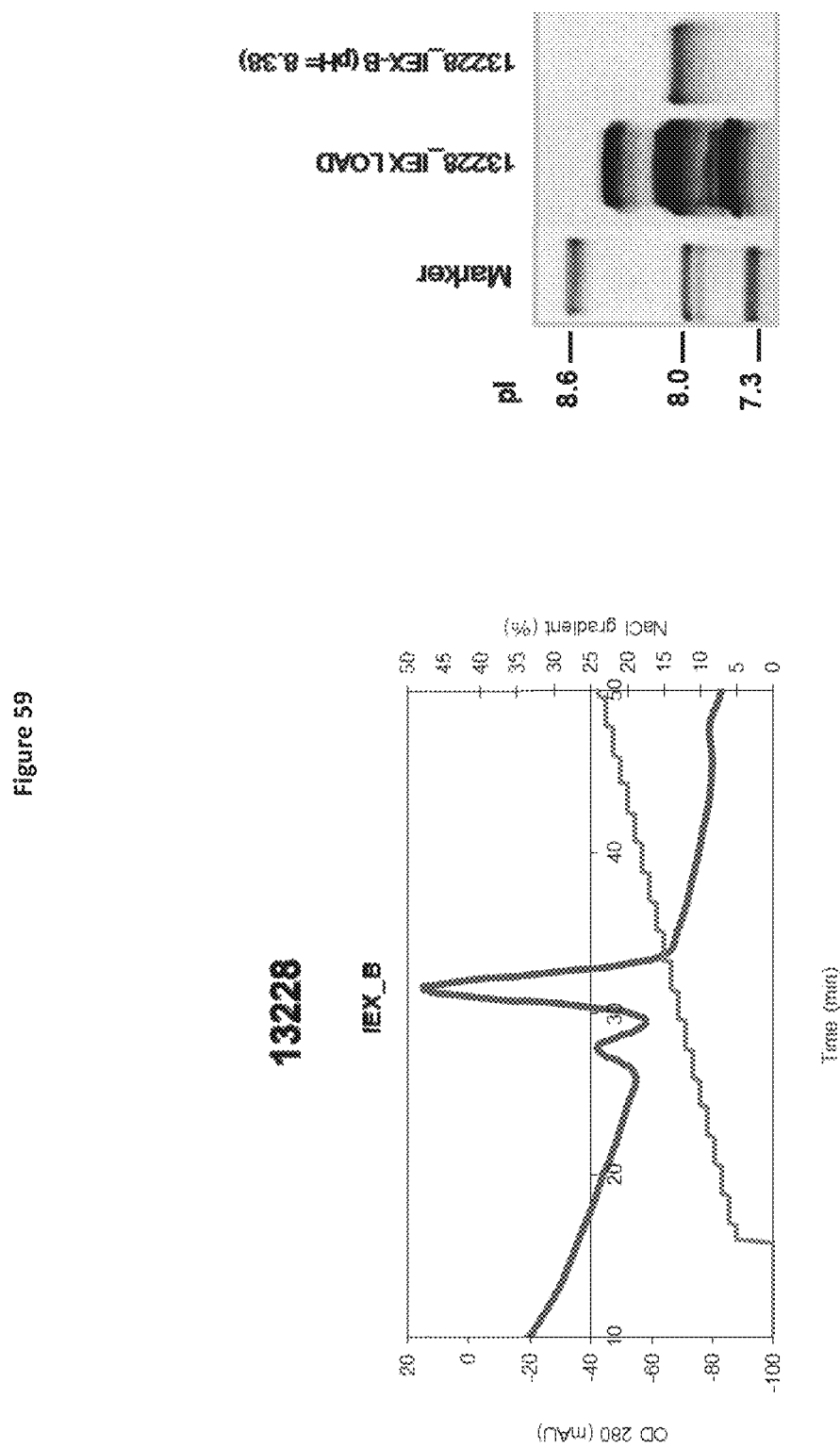
FIG. 59. Cation exchange chromatography showing purification of the heterodimer species of an anti-CD19×CD3 bispecific antibody containing isosteric engineered constant regions. Also shown is an IEF gel of protein A purified material as well as the isolated heterodimer bispecific.

A particularly useful configuration is depicted in FIG. 45, that co-engages at least a first and a second antigen. First and second antigens of the invention are herein referred to as antigen-1 and antigen-2 respectively. One heavy chain of the antibody contains an single chain Fv ("scFv", as defined below) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener (see Figure). The two chains are brought together by the use of amino acid variants in the constant regions (e.g. the Fc domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.)

In addition, as further described below, additional amino acid substitutions can be engineered into the Fc region of the proteins of the invention, to alter a variety of additional functionalities such as altered FcγR binding ((e.g. including increasing ADCC, for example (see the disclosure in U.S. Pat. No. 8,188,231, incorporated by reference), increasing binding to FcγRIIb (see for example the disclosures of U.S. Pat. No. 8,063,187 and others in the lineage), ablating FcγR binding, see FIG. 54), altered FcRn binding (to alter half-life of the antibody in the serum; see U.S. Pat. No. 8,367,805, incorporated by reference), etc.

In further embodiments, in addition to steric variants, isosteric variants as heterodimerization variants can also be used, as more fully described below.

In particular, the invention provides bispecific antibodies that incorporate a monovalent binding of human CD3 (episilon) are finding use for a variety of treatments. The present invention is directed to a variety of new variable sequences that bind to CD3 that display altered properties, including, but not limited to, altered stability and altered binding affinity, in many cases improved stability and improved binding affinity (although as will be appreciated by those in the art, in some cases lowered binding affinity can be an advantage). In addition, these optimized sequences also bind to primate CD3, thus allowing preclinical animal testing.

These variable sequences can be used in scFv formats, such as depicted in FIGS. 7A-7U and 13A-13B, or the variable regions can be used as "traditional" heavy and light variable regions, used in standard monoclonal antibodies, or in non-scFv multispecific formats. The invention further relates to nucleic acids encoding for the polypeptide, to vectors comprising the same and to host cells comprising the vector(s) and to methods of producing the polypeptide. In another aspect, the invention provides for a pharmaceutical composition comprising the mentioned polypeptide and medical uses of the polypeptide.

In addition, it should be noted that the pI variants of the heterodimerization variants give an additional benefit for the analytics and quality control process of bispecific antibodies, as, particularly in the case of CD3 antibodies, the ability to either eliminate, minimize and distinguish when homodimers are present is significant. Similarly, the ability to reliably test the reproducibility of the heterodimeric protein production is important.

II. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding is the double variant 236R/328R, and 236R and 328R separately as well.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233#designates a deletion of glutamic acid at position 233. Additionally, EDA233- or EDA233#designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides". The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and norleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CHL VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcqammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life, are discussed in Legend A of FIG. 14.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc fusion protein" or "immunoadhesin" herein is meant a protein comprising an Fc region, generally linked (optionally through a linker moiety, as described herein) to a different protein, such as a binding moiety to a target protein, as described herein).

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. A target antigen may be a protein, carbohydrate, lipid, or other chemical compound. A wide number of suitable target antigens are described below.

By "strandedness" in the context of the monomers of the heterodimeric proteins of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. This is similarly true with the use of charged scFv linkers.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

Heterodimeric Proteins

The present invention is directed to the generation of multispecific, particularly bispecific binding proteins, and in particular, multispecific antibodies. Antibodies The present invention relates to the generation of heterodimeric antibodies, generally therapeutic antibodies, through the use of "heterodimerization amino acid variants". As is discussed below, the term "antibody" is used generally. Antibodies that find use in the present invention can take on a number of formats as described herein, including traditional antibodies as well as antibody derivatives, fragments and mimetics, described below. In general, the term "antibody" includes any polypeptide that includes at least one constant domain, including, but not limited to, CH1, CH2, CH3 and CL.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown herein, the present invention covers heterodimers that can contain one or both chains that are IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

Throughout the present specification, the Kabat numbering system is generally used when referring to a residue in the variable domain (approximately, residues 1-107 of the light chain variable region and residues 1-113 of the heavy chain variable region) (e.g, Kabat et al., supra (1991)).

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning."

In some embodiments, the antibodies are full length. By "full length antibody" herein is meant the structure that constitutes the natural biological form of an antibody, including variable and constant regions, including one or more modifications as outlined herein.

Alternatively, the antibodies can be a variety of structures, including, but not limited to, antibody fragments, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and fragments of each, respectively.

Antibody Fragments

In one embodiment, the antibody is an antibody fragment. Of particular interest are antibodies that comprise Fc regions, Fc fusions, and the constant region of the heavy chain (CH1-hinge-CH2-CH3), again also including constant heavy region fusions.

Specific antibody fragments include, but are not limited to, (i) the Fab fragment consisting of VL, VH, CL and CH1 domains, (ii) the Fd fragment consisting of the VH and CH1 domains, (iii) the Fv fragment consisting of the VL and VH domains of a single antibody; (iv) the dAb fragment (Ward et al., 1989, Nature 341:544-546, entirely incorporated by reference) which consists of a single variable, (v) isolated CDR regions, (vi) F(ab')2 fragments, a bivalent fragment comprising two linked Fab fragments (vii) single chain Fv molecules (scFv), wherein a VH domain and a VL domain are linked by a peptide linker which allows the two domains to associate to form an antigen binding site (Bird et al., 1988, Science 242:423-426, Huston et al., 1988, Proc. Natl. Acad. Sci. U.S.A. 85:5879-5883, entirely incorporated by reference), (viii) bispecific single chain Fv (WO 03/11161, hereby incorporated by reference) and (ix) "diabodies" or "triabodies", multivalent or multispecific fragments constructed by gene fusion (Tomlinson et. al., 2000, Methods Enzymol. 326:461-479; WO94/13804; Holliger et al., 1993, Proc. Natl. Acad. Sci. U.S.A. 90:6444-6448, all entirely incorporated by reference). The antibody fragments may be modified. For example, the molecules may be stabilized by the incorporation of disulphide bridges linking the VH and VL domains (Reiter et al., 1996, Nature Biotech. 14:1239-1245, entirely incorporated by reference).

Chimeric and Humanized Antibodies

In some embodiments, the scaffold components can be a mixture from different species. As such, if the protein is an antibody, such antibody may be a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

In one embodiment, the antibody is a minibody. Minibodies are minimized antibody-like proteins comprising a scFv joined to a CH3 domain. Hu et al., 1996, Cancer Res. 56:3055-3061, entirely incorporated by reference. In some cases, the scFv can be joined to the Fc region, and may include some or the entire hinge region.

scFv

The anti-CD3 and anti-CD19 variable heavy and variable light chains of the present invention find particular use in bispecifics comprising the "triple F" formats that utilize scFv as the antigen binding domain on one monomer.

The present invention also includes engineering the variable heavy and variable light chains to include disulfides for stability as needed; see Brinkman et al. PNAS 90:7538 (1993) and FIG. 44, for example.

scFv Linkers

Of particular use in many embodiments of the present invention are scFv fragments, which can be optionally attached to Fc domains (for example, in the "bottle opener" formats of the invention or "dual scFv" formats) for use in the present invention. In some embodiments, the variable heavy and variable light chains are covalently attached using linkers. Traditionally, flexible linkers such as those containing glycine and serine (generally discussed herein) are used. In some embodiments of the invention, particularly in the case of bispecific antibodies (e.g. heterodimeric antibodies and/or heterodimeric proteins) that incorporate pI variants to allow for ease of purification, charged scFv linkers can be used. These are depicted in FIG. 20. As for all the heterodimeric proteins discussed herein that utilize pI variants for purification, the "strandedness" of the variants, including the charged scFv linkers, is preserved. Generally the starting (e.g. unmodified) isoelectric point of each Fv is determined, and the incorporation of pI variants is done according to which monomer will be modified to increase or decrease the pI (or both monomers will be engineered as described herein). That is, if the first antigen binding domain (e.g. Fv) has a higher pI than the second Fv, then pI variants, including charged scFv linkers, are engineered into the proper monomer; for example, a positively charged linker is used on the the first monomer and (if applicable, such in a dual scFv format) a negatively charged linker can be used in the second monomer.

Fc Fusion Heterodimeric Proteins

In addition to heterodimeric antibody constructs, the invention further provides Fc fusion heterodimeric proteins that include a novel anti-CD3 variable domain (such as an scFv) as one of the binding moieties. However, rather than have the Fc domain of an antibody joined to another antibody variable region, the Fc domain can be joined to other moieties, particularly binding moieties such as ligands. That is, one Fc domain of the heavy chain may be an anti-CD3 domain as described herein, and the other Fc domain of the heavy chain can be a ligand. By "Fc fusion" as used herein is meant a protein wherein one or more polypeptides is operably linked to an Fc region. Fc fusion is herein meant to be synonymous with the terms "immunoadhesin", "Ig fusion", "Ig chimera", and "receptor globulin" (sometimes with dashes) as used in the prior art (Chamow et al., 1996, Trends Biotechnol 14:52-60; Ashkenazi et al., 1997, Curr Opin Immunol 9:195-200, both entirely incorporated by reference). An Fc fusion combines the Fc region of an immunoglobulin with a fusion partner, which in general can be any protein or small molecule. Virtually any protein or small molecule may be linked to Fc to generate an Fc fusion. Protein fusion partners may include, but are not limited to, the variable region of any antibody, the target-binding region of a receptor, an adhesion molecule, a ligand, an enzyme, a cytokine, a chemokine, or some other protein or protein domain. Small molecule fusion partners may include any therapeutic agent that directs the Fc fusion to a therapeutic target. Such targets may be any molecule, preferably an extracellular receptor, which is implicated in disease. Thus, the IgG variants can be linked to one or more fusion partners.

Thus, while many embodiments herein depict antibody components such as variable heavy and light chains or scFvs, other binding moeities can be fused to Fc regions to form heterodimeric proteins. For example, as discussed in Kontermann, supra, any number of dual targeting strategies can be done. For example (assuming only two binding moieties per heterodimer, e.g generally one per monomer), both monomers can bind and/or neutralize two ligands or two receptors, or bind and activate two ligands or two receptors. Similarly, one monomer may bind a receptor and the other a ligand (again, independently activating or neutralizing the binding partner). Further, each monomer may bind to same receptor or ligand in different locations (e.g. different epitopes). See FIG. 1 of Kontermann, expressly incorporated by reference. Suitable receptors and ligands are outlined below in the "Target" section.

Specific Sequences

Specific sequences for optimized CD3 binding moieties are shown in FIG. 2A-2YY.

It should be understood that the increased stability of the optimized variable and optimized light chains (as well as the scFv chains, listed in FIG. 2A-2YY) can be attributed to framework regions as well as the CDRs. Thus, it should be understood that the disclosure of the entire variable sequences (or the scFv) includes the specific disclosure of the framework regions as well, although they are not separately numbered as are the CDRs (see FIG. 17A-17I).

FIG. 22 depicts some preferred substitutions of CDRs and framework regions that contribute particularly to stability. These components can be optionally and independently combined with any other components, such as other CDRs or frameworks. Thus, for example, the framework substitutions of FIG. 22 can be combined with the following two sets of CDRs (vhCDR1-2-3-vlCDR1-2-3): KYAMN-RIRSKY-NNYATYYADSVKD-HGNFGNSYISYWAY-GSST-GAVTSGNYPN-GTKFLAP-VLWYSNRWV and TYAMN-RIRSKYNNYATYYADSVKD-HGNFGNSYVSWFAY-RSSTGAVTTSNYAN-GTKFLAP-ALWYSNLWV.

Anti-CD3/Anti CD19 Formats

Figures 9A, 9B, 9C:
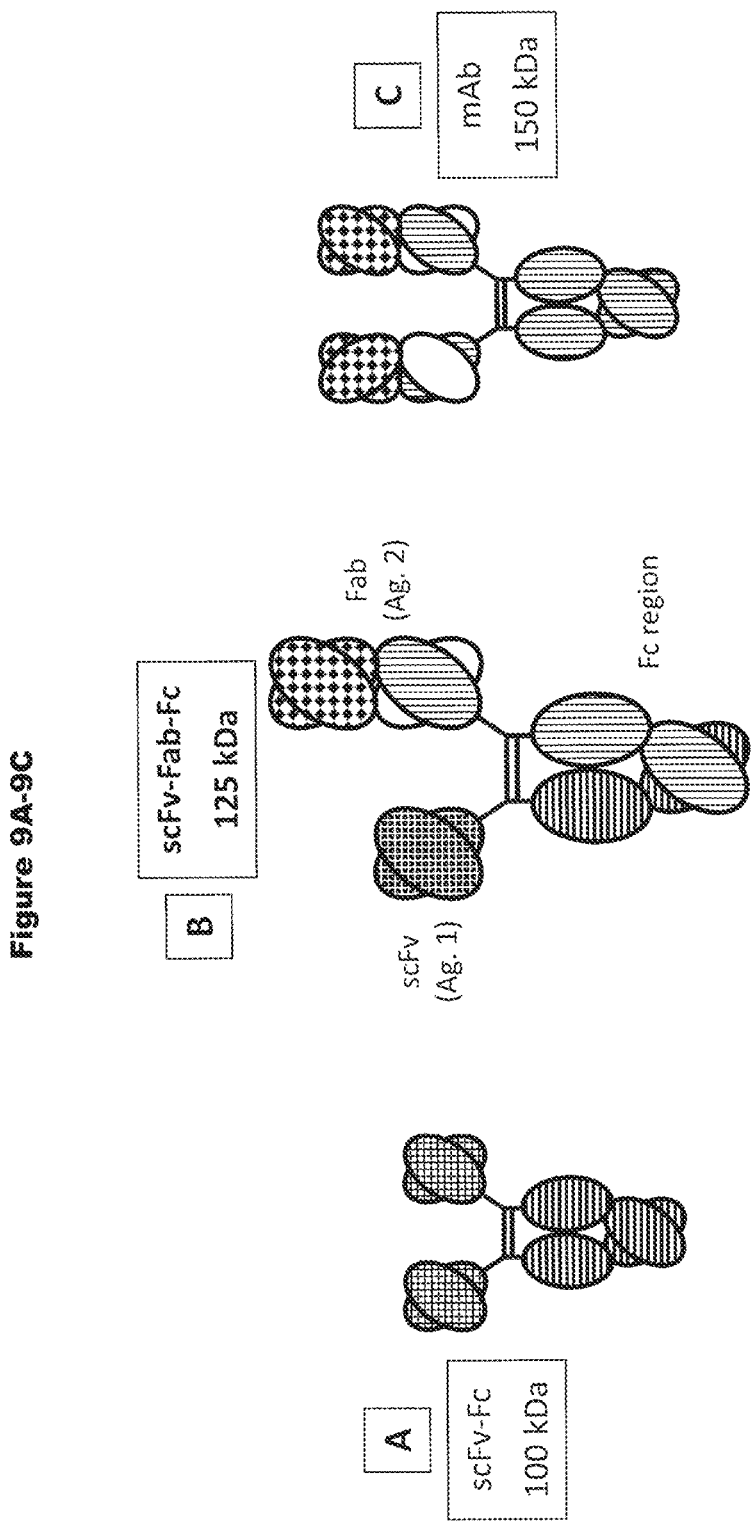
FIGS. 9A, 9B and 9C illustrate the "triple F" format for bispecific immunoglobulins.

One preferred embodiment of the present invention uses bispecific formats, particularly but not limited to dual scFv-Fc formats (FIG. 7A) and triple F formats (FIG. 9B) utilizing stabilized scFv sequences, heterodimerization variants, and optionally Fc and FcRn variants.

Heterodimerization Variants

Accordingly, the present invention provides heterodimeric proteins based on the use of monomers containing variant heavy chain constant regions as a first domain. By "monomer" herein is meant one half of the heterodimeric protein. It should be noted that antibodies are actually tetrameric (two heavy chains and two light chains). In the context of the present invention, as applicable, one pair of heavy-light chains is considered a "monomer". In the case where an Fv region is one fusion partner (e.g. heavy and light chain) and a non-antibody protein is another fusion partner, each "half" is considered a monomer. Essentially, each monomer comprises sufficient heavy chain constant region to allow heterodimerization engineering, whether that be all the constant region, e.g. Ch1-hinge-CH2-CH3, the Fc region (CH2-CH3), or just the CH3 domain.

The variant heavy chain constant regions can comprise all or part of the heavy chain constant region, including the full length construct, CH1-hinge-CH2-CH3, or portions thereof, including for example CH2-CH3 or CH3 alone. In addition, the heavy chain region of each monomer can be the same backbone (CH1-hinge-CH2-CH3 or CH2-CH3) or different. N- and C-terminal truncations and additions are also included within the definition; for example, some pI variants include the addition of charged amino acids to the C-terminus of the heavy chain domain.

Furthermore, in addition to the pI substitutions outlined herein, the heavy chain regions may also contain additional amino acid substitutions, including changes for altering Fc binding as discussed below.

In addition, some monomers can utilize linkers between the variant heavy chain constant region and the fusion partner. Traditional peptide linkers can be used, including flexible linkers of glycine and serine. In some cases, the linkers for use as components of the monomer are different from those defined below for the ADC constructs, and are in many embodiments not cleavable linkers (such as those susceptible to proteases), although cleavable linkers may find use in some embodiments.

The heterodimerization variants include a number of different types of variants, including, but not limited to, steric variants, pI variants, and other variants (e.g. charge variants), that can be optionally and independently combined with any other variants. In these embodiments, it is important to match "monomer A" with "monomer B"; that is, if a heterodimeric protein relies on both steric variants and pI variants, these need to be correctly matched to each monomer: e.g. the set of steric variants that work (1 set on monomer A, 1 set on monomer B) is combined with pI variant sets (1 set on monomer A, 1 set on monomer B), such that the variants on each monomer are designed to achieve the desired function.

Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are shown in FIG. 11A-11E.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. FIG. 4A-4B, further described below, identifies a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization. Some of these variants are shown in the Figures.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend of which are incorporated expressly by reference herein.

In some embodiments, the steric variants outlined herein can be optionally and independently incorporated with any pI variant (or other variants such as Fc variants, FcRn variants, etc.) into one or both monomers.

Isosteric Variants

In some embodiments, isosteric variants are used. Isosteric amino acids have similarly shaped side chains and differ by only a single atom. Examples are D to N or N to D substitutions and E to Q or Q to E subsitutions. These subsitutions are expected to have less potential for negatively impacting protein stability and possible immunogenicity. In deciding which positions to mutate, the surrounding environment and number of contacts the WT amino acid makes with its neighbors was taken into account such as to minimize the impact of a substitution or set of substitutions on structure and/or function. Also considered were possible impacts on binding to FcγR, FcRn, and protein A. The solvent accessibility or fraction exposed of each heavy chain constant region position were calculated using relevant crystal structures. Based on this analysis, a number of substitutions were identified that altered pI but have minimal impact on the biophysical properties of the domains. Substitutions are shown in FIG. 23A-23C. As for all the variants outlined herein, these can be combined with Fc and FcRn variants, as well as other heterodimerization variants. pI (Isoelectric point) Variants for Heterodimers In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 14.

Heavy Chain Acidic pI Changes

Accordingly, when one monomer comprising a variant heavy chain constant domain is to be made more positive (e.g. lower the pI), one or more of the following substitutions can be made: S119E, K133E, K133Q, T164E, K205E, K205Q, N208D, K210E, K210Q, K274E, K320E, K322E, K326E, K334E, R355E, K392E, a deletion of K447, adding peptide DEDE at the c-terminus, G137E, N203D, K274Q, R355Q, K392N and Q419E. As outlined herein and shown in the figures, these changes are shown relative to IgG1, but all isotypes can be altered this way, as well as isotype hybrids.

In the case where the heavy chain constant domain is from IgG2-4, R133E and R133Q can also be used.

Basic pI Changes

Accordingly, when one monomer comprising a variant heavy chain constant domain is to be made more negative (e.g. increase the pI), one or more of the following substitutions can be made: Q196K, P217R, P228R, N276K and H435R. As outlined herein and shown in the figures, these changes are shown relative to IgG1, but all isotypes can be altered this way, as well as isotype hybrids.

Antibody Heterodimers Light Chain Variants

In the case of antibody based heterodimers, e.g. where at least one of the monomers comprises a light chain in addition to the heavy chain domain, pI variants can also be made in the light chain. Amino acid substitutions for lowering the pI of the light chain include, but are not limited to, K126E, K126Q, K145E, K145Q, N152D, S156E, K169E, S202E, K207E and adding peptide DEDE at the c-terminus of the light chain. Changes in this category based on the constant lambda light chain include one or more substitutions at R108Q, Q124E, K126Q, N138D, K145T and Q199E. In addition, increasing the pI of the light chains can also be done.

Isotypic Variants

In addition, many embodiments of the invention rely on the "importation" of pI amino acids at particular positions from one IgG isotype into another, thus reducing or eliminating the possibility of unwanted immunogenicity being introduced into the variants. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the Figures. Alternatively, the pI of each monomer can be compared.

pI Variants that Also Confer Better FcRn In Vitro Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

Combination of Heterodimeric Variants

As will be appreciated by those in the art, all of the recited heterodimerization variants can be optionally and independently combined in any way, as long as they retain their "strandedness" or "monomer partition". In addition, all of these variants can be combined into any of the hterodimerization formats. See FIG. 21A-21B.

In the case of pI variants, while embodiments finding particular use are shown in the Figures, other combinations can be generated, following the basic rule of altering the pI difference between two monomers to facilitate purification.

Suitable Multispecific Formats

As will be appreciated by those in the art, there are a wide variety of possible multispecific formats that find use in the present invention, see for example Kontermann, mAbs 4(2): 182-197 (2012), hereby incorporated by reference in its entirety and particularly Tables 1 and 2 and FIGS. 1A-1C and 2A-2YY, with specific reference to the constructs of Kontermann that contain an Fc region. See also Klein et al., Of use in the present invention are heterodimers that contain constant heavy chain and/or constant light chain regions, and in particular, Fc domains. That is, some variants discussed herein are within the vhCH1, although many of the variants are within the Fc domain (hinge-CH2-CH3).

As will be appreciated by those in the art and discussed more fully below, the heterodimeric fusion proteins of the present invention can take on a wide variety of configurations, as are generally depicted in the Figures. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Furthermore, as is shown, these two configurations can be combined, where there can be triple or quadruple specificities based on the particular combination. Thus, the present invention provides "multispecific" binding proteins, including multispecific antibodies.

Figures 7C, 7D, 7E, 7F:
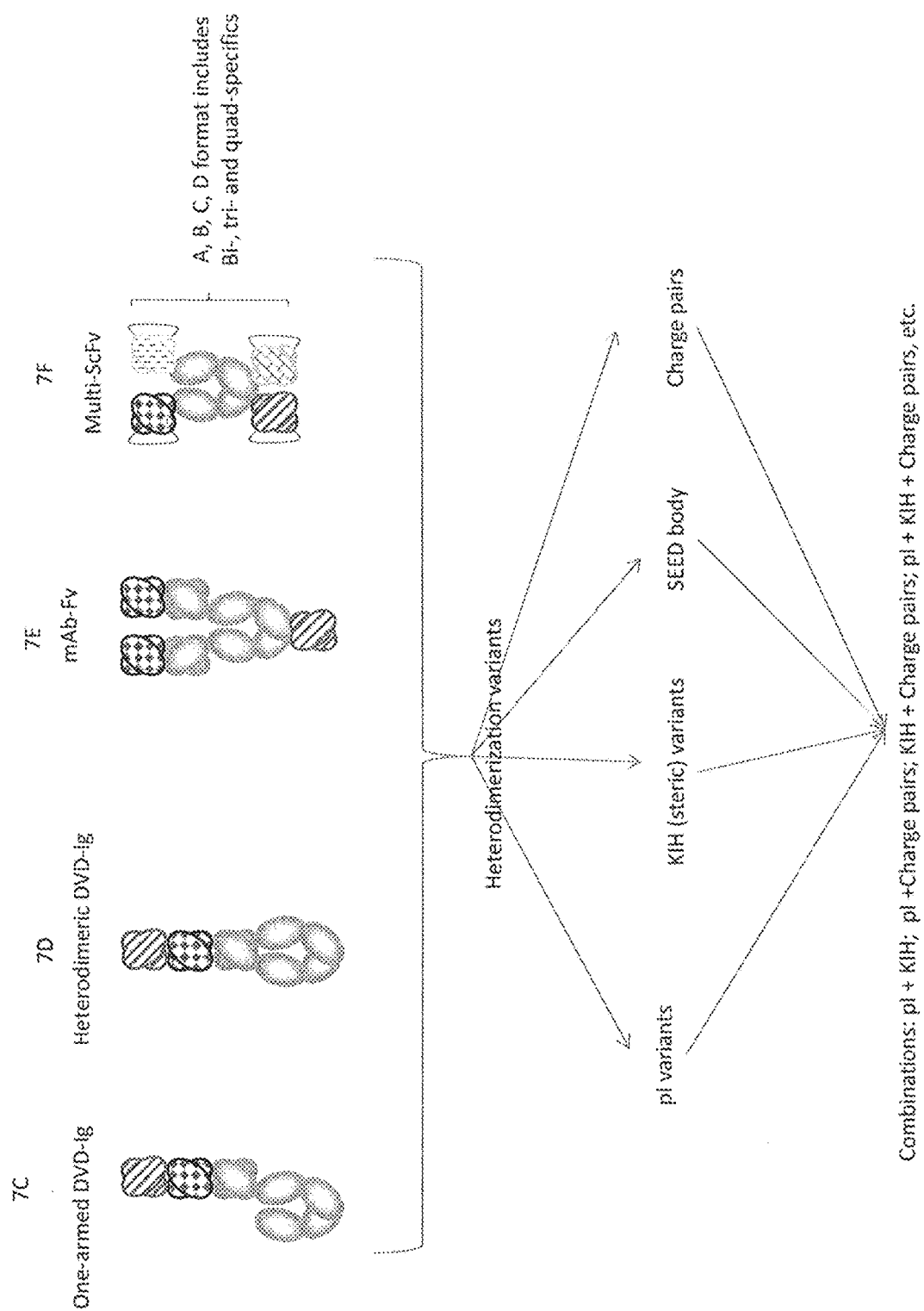
FIG. 7C depicts the "one armed" version of DVD-Ig which utilizes two different variable heavy and variable light domains.
FIG. 7D is similar, except that rather than an "empty arm", the variable heavy and light chains are on opposite heavy chains.
FIG. 7E is generally referred as "mAb-Fv".
FIG. 7F depicts a multi-scFv format; as will be appreciated by those in the art, similar to the "A, B, C, D" formats discussed herein, there may be any number of associated scFvs (or, for that matter, any other binding ligands or functionalities). Thus, FIG. 7F could have 1, 2, 3 or 4 scFvs (e.g. for bispecifics, the scFv could be "cis" or "trans", or both on one "end" of the molecule).
Figures 7G, 7H, 7I, 7J:
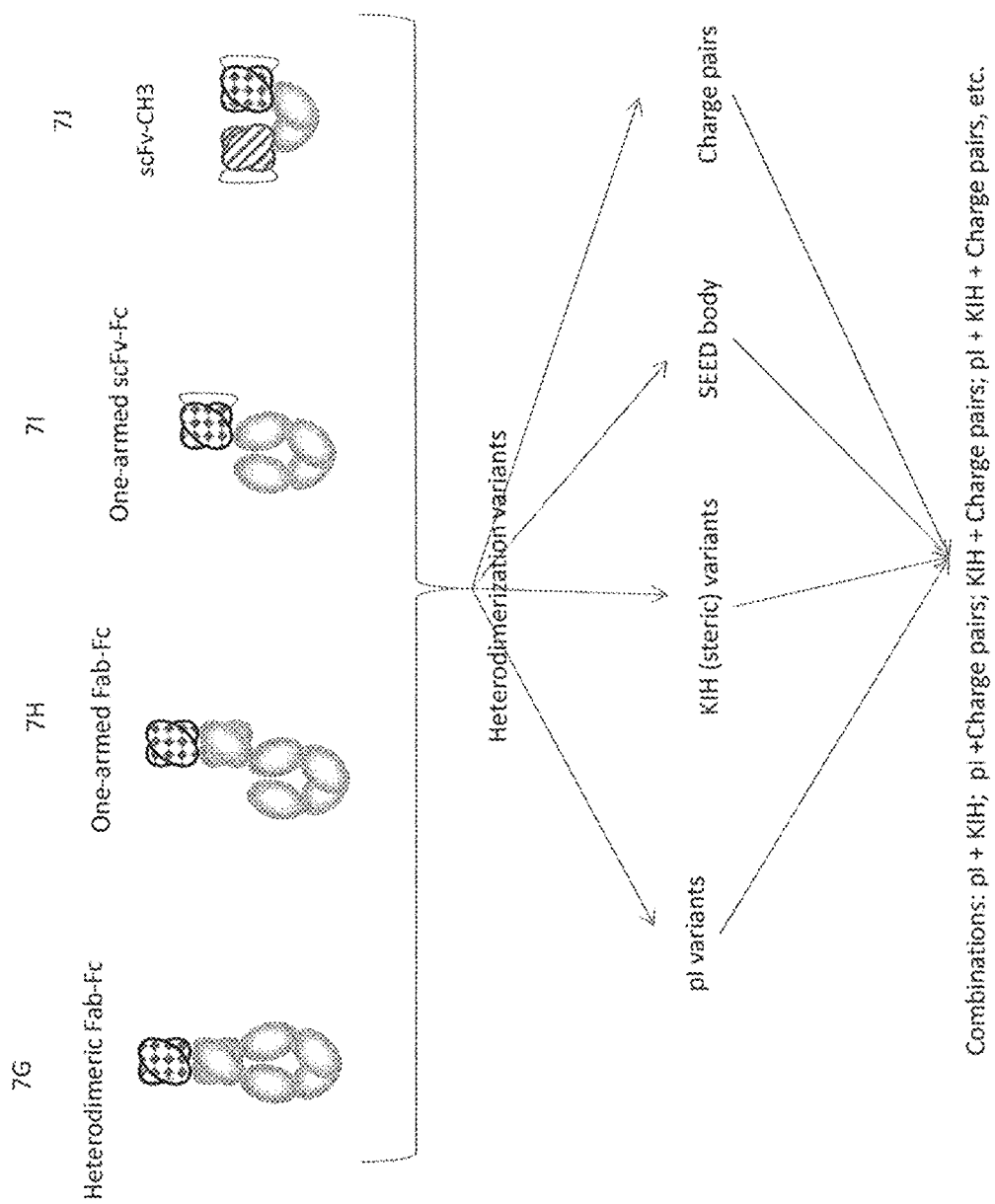
FIG. 7G depicts a heterodimeric FabFc with the Fab being formed by two different heavy chains one containing heavy chain Fab sequences and the other containing light chain Fab sequences.
FIG. 7H dpeicts the "one armed Fab-Fc", where one heavy chain comprises the Fab.
FIG. 7I depicts a "one armed scFv-Fc", wherein one heavy chain Fc comprises an scFv and the other heavy chain is "empty".
FIG. 7J shows a scFv-CH3, wherein only heavy chain CH3 regions are used, each with their own scFv.
Figures 7K, 7L:
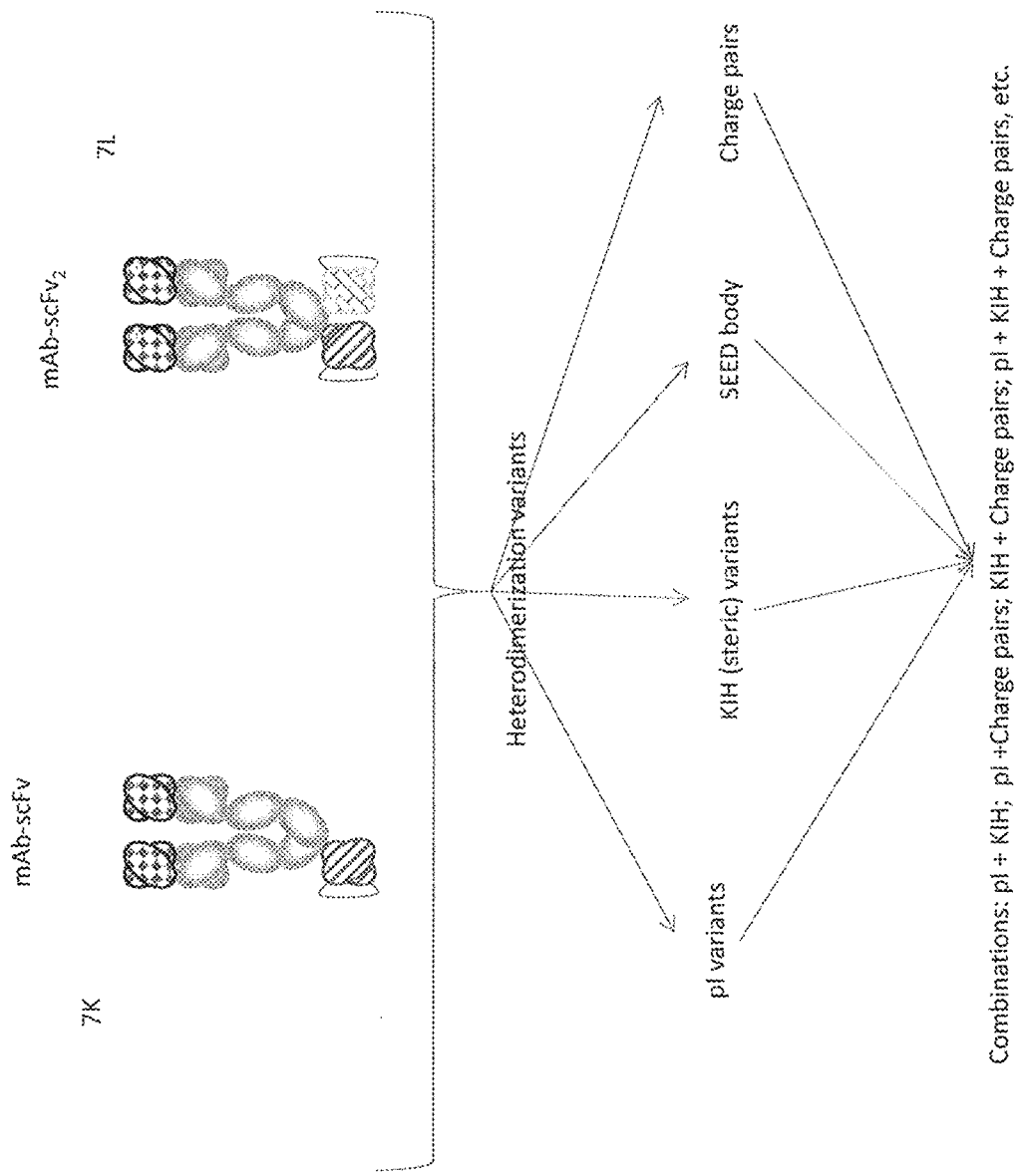
FIG. 7K depicts a mAb-scFv, wherein one end of the molecule engages an antigen bivalently with a monovalent engagement using an scFv on one of the heavy chains.
FIG. 7L depicts the same structure except that both heavy chains comprise an additional scFv, which can either bind the same antigen or different antigens.
Figures 7S, 7T:
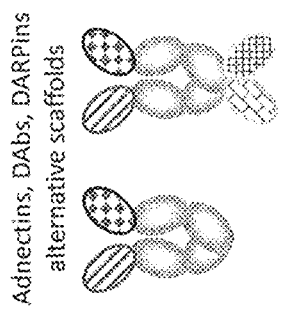
Figure 7U:
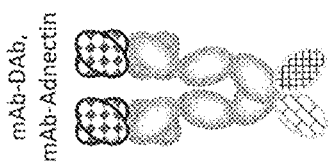
Figures 8A, 8B, 8C, 8D, 8E:
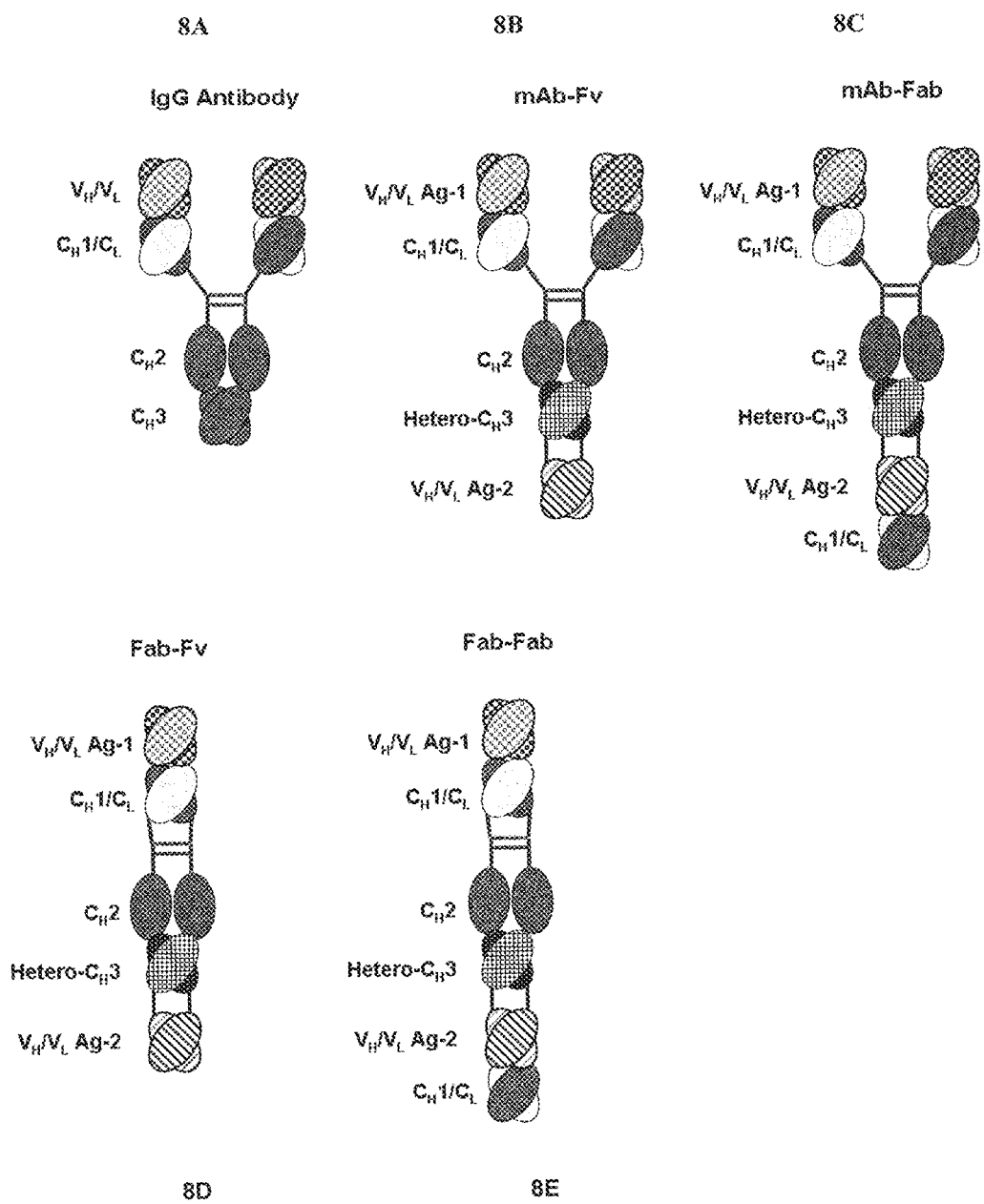
FIGS. 8A-8E illustrate mAb-Fv and mAb-Fab immunoglobulin formats. A native IgG1 antibody is included for reference (FIG. 8A). Although mAb-Fv (FIG. 8B) and mAb-Fab (FIG. 8C) immunoglobulins can be constructed with homodimeric CH3 domains, preferably they utilize heterodimeric CH3 domains, as depicted. Bivalent binding to antigen-1 (Ag-1) is mediated by the N-terminal VH/VL pairs (Fv-1), while monovalent binding to antigen-2 (Ag-2) is mediated by the C-terminal VH/VL pair (Fv-2). Also shown are the Fab-Fv (FIG. 8D) and Fab-Fab (FIG. 8E) analogs that bind both antigen-1 and antigen-2 monovalently. As for the other figures in FIG. 7, FIGS. 7P to 7S can also include heterodimerization variants, can include heterodimerization variants such as pI variants, knobs in holes (KIH, also referred to herein as steric variants), charge pairs, and SEED body structures, optionally in any combination.

In some embodiments, the heterodimers resemble traditional antibodies although they are bispecific and have two different variable regions; see FIG. 7A-7U. As outlined herein, the constant regions comprise heterodimerization variants, such as steric variants ("knobs in holes", sometimes referred to in the art as "kih" variants) or pI variants, etc. In some cases, to reduce the complexity with regard to the light chains, some of these formats utilize variable regions that share a common light chain (e.g. two separate heavy chains with a light chain that will assemble with both but confers two different specificities).

In some embodiments, the heterodimers are bispecific in a format generally referred to in the art as "CrossMab". In this embodiment, in addition to using the heterodimeric variants described herein, one heavy chain monomer and one light chain monomer are also engineered such that the heavy chain monomer comprises a constant light region in place of the vhCH1domain, and the light chain contains the vhCH1 region with the variable light region. This ensures that the correct light chains will pair with the correct heavy chains. See FIG. 7A-7U and Schaefer et al., PNAS 108(27) 11187-11192 (hereby incorporated by reference in its entirety.

In some embodiments, sometimes referred to in the art as IgG-scFab, one of the heavy chains has a scFab on it, such that one antigen is engaged bivalently and the other monovalently (e.g. two binding regions on one "end" and a single binding region on the other "end"). See FIG. 7A-7U.

In some embodiments, sometimes referred to as mAb-Fv, each heavy chain of the heterodimer has an additional variable region on the terminus. One monomer has the variable heavy domain and the other monomer has a variable light domain, see FIG. 7A-7U. See for example PCT US2010/047741, hereby incorporated by reference. In this embodiment, in general, there are two different types of antibody analogs that allow for co-engagement mechanisms, one that utilizes three antigen binding domains (e.g. one antigen is bound bivalently and the other is bound monovalently, although as is further described below, there can also be three different antigens that are bound or a single antigen), and one that relies on two antigen binding domains (e.g. each antigen is bound monovalently).

Additional Modifications

In addition to the modifications outlined above, other modifications can be made. For example, the molecules may be stabilized by the incorporation of disulphide bridges linking the VH and VL domains (Reiter et al., 1996, Nature Biotech. 14:1239-1245, entirely incorporated by reference). In addition, there are a variety of covalent modifications of antibodies that can be made as outlined below.

Covalent modifications of antibodies are included within the scope of this invention, and are generally, but not always, done post-translationally. For example, several types of covalent modifications of the antibody are introduced into the molecule by reacting specific amino acid residues of the antibody with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues may also be derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole and the like.

In addition, modifications at cysteines are particularly useful in antibody-drug conjugate (ADC) applications, further described below. In some embodiments, the constant region of the antibodies can be engineered to contain one or more cysteines that are particularly "thiol reactive", so as to allow more specific and controlled placement of the drug moiety. See for example U.S. Pat. No. 7,521,541, incorporated by reference in its entirety herein.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1M sodium cacodylate at pH 6.0.

Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using 125I or 131I to prepare labeled proteins for use in radioimmunoassay, the chloramine T method described above being suitable.

Carboxyl side groups (aspartyl or glutamyl) are selectively modified by reaction with carbodiimides (R'—N═C═N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking antibodies to a water-insoluble support matrix or surface for use in a variety of methods, in addition to methods described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cynomolgusogen bromide-activated carbohydrates and the reactive substrates described in U.S. Pat. Nos. 3,969,287; 3,691,016; 4,195,128; 4,247,642; 4,229,537; and 4,330,440, all entirely incorporated by reference, are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, pp. 79-86 [1983], entirely incorporated by reference), acetylation of the N-terminal amine, and amidation of any C-terminal carboxyl group.

In addition, as will be appreciated by those in the art, labels (including fluorescent, enzymatic, magnetic, radioactive, etc. can all be added to the antibodies (as well as the other compositions of the invention).

Glycosylation

Another type of covalent modification is alterations in glycosylation. In another embodiment, the antibodies disclosed herein can be modified to include one or more engineered glycoforms. By "engineered glycoform" as used herein is meant a carbohydrate composition that is covalently attached to the antibody, wherein said carbohydrate composition differs chemically from that of a parent antibody. Engineered glycoforms may be useful for a variety of purposes, including but not limited to enhancing or reducing effector function. A preferred form of engineered glycoform is afucosylation, which has been shown to be correlated to an increase in ADCC function, presumably through tighter binding to the FcγRIIIa receptor. In this context, "afucosylation" means that the majority of the antibody produced in the host cells is substantially devoid of fucose, e.g. 90-95-98% of the generated antibodies do not have appreciable fucose as a component of the carbohydrate moiety of the antibody (generally attached at N297 in the Fc region). Defined functionally, afucosylated antibodies generally exhibit at least a 50% or higher affinity to the FcγRIIIa receptor.

Engineered glycoforms may be generated by a variety of methods known in the art (Umaña et al., 1999, Nat Biotechnol 17:176-180; Davies et al., 2001, Biotechnol Bioeng 74:288-294; Shields et al., 2002, J Biol Chem 277:26733-26740; Shinkawa et al., 2003, J Biol Chem 278:3466-3473; U.S. Pat. No. 6,602,684; U.S. Ser. No. 10/277,370; U.S. Ser. No. 10/113,929; PCT WO 00/61739A1; PCT WO 01/29246A1; PCT WO 02/31140A1; PCT WO 02/30954A1, all entirely incorporated by reference; (Potelligent® technology [Biowa, Inc., Princeton, N.J.]; GlycoMAb® glycosylation engineering technology [Glycart Biotechnology AG, Zurich, Switzerland]). Many of these techniques are based on controlling the level of fucosylated and/or bisecting oligosaccharides that are covalently attached to the Fc region, for example by expressing an IgG in various organisms or cell lines, engineered or otherwise (for example Lec-13 CHO cells or rat hybridoma YB2/0 cells, by regulating enzymes involved in the glycosylation pathway (for example FUT8 [α1,6-fucosyltranserase] and/or β1-4-N-acetylglucosaminyltransferase III [GnTIII]), or by modifying carbohydrate(s) after the IgG has been expressed. For example, the "sugar engineered antibody" or "SEA technology" of Seattle Genetics functions by adding modified saccharides that inhibit fucosylation during production; see for example 20090317869, hereby incorporated by reference in its entirety. Engineered glycoform typically refers to the different carbohydrate or oligosaccharide; thus an antibody can include an engineered glycoform.

Alternatively, engineered glycoform may refer to the IgG variant that comprises the different carbohydrate or oligosaccharide. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antibody amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antibody is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 and in Aplin and Wriston, 1981, CRC Crit. Rev. Biochem., pp. 259-306, both entirely incorporated by reference.

Removal of carbohydrate moieties present on the starting antibody (e.g. post-translationally) may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131, both entirely incorporated by reference. Enzymatic cleavage of carbohydrate moieties on polypeptides can be achieved by the use of a variety of endo- and exo-glycosidases as described by Thotakura et al., 1987, Meth. Enzymol. 138:350, entirely incorporated by reference. Glycosylation at potential glycosylation sites may be prevented by the use of the compound tunicamycin as described by Duskin et al., 1982, J. Biol. Chem. 257:3105, entirely incorporated by reference. Tunicamycin blocks the formation of protein-N-glycoside linkages.

Another type of covalent modification of the antibody comprises linking the antibody to various nonproteinaceous polymers, including, but not limited to, various polyols such as polyethylene glycol, polypropylene glycol or polyoxyalkylenes, in the manner set forth in, for example, 2005-2006 PEG Catalog from Nektar Therapeutics (available at the Nektar website) U.S. Pat. Nos. 4,640,835; 4,496,689; 4,301,144; 4,670,417; 4,791,192 or 4,179,337, all entirely incorporated by reference. In addition, as is known in the art, amino acid substitutions may be made in various positions within the antibody to facilitate the addition of polymers such as PEG. See for example, U.S. Publication No. 2005/0114037A1, entirely incorporated by reference.

Other Fc Modifications

In addition to heterodimerization variants, other amino acid modifications (particularly amino acid substitutions) find use to alter additional properties of the heterodimer.

FcγR Variants

Figure 41A:
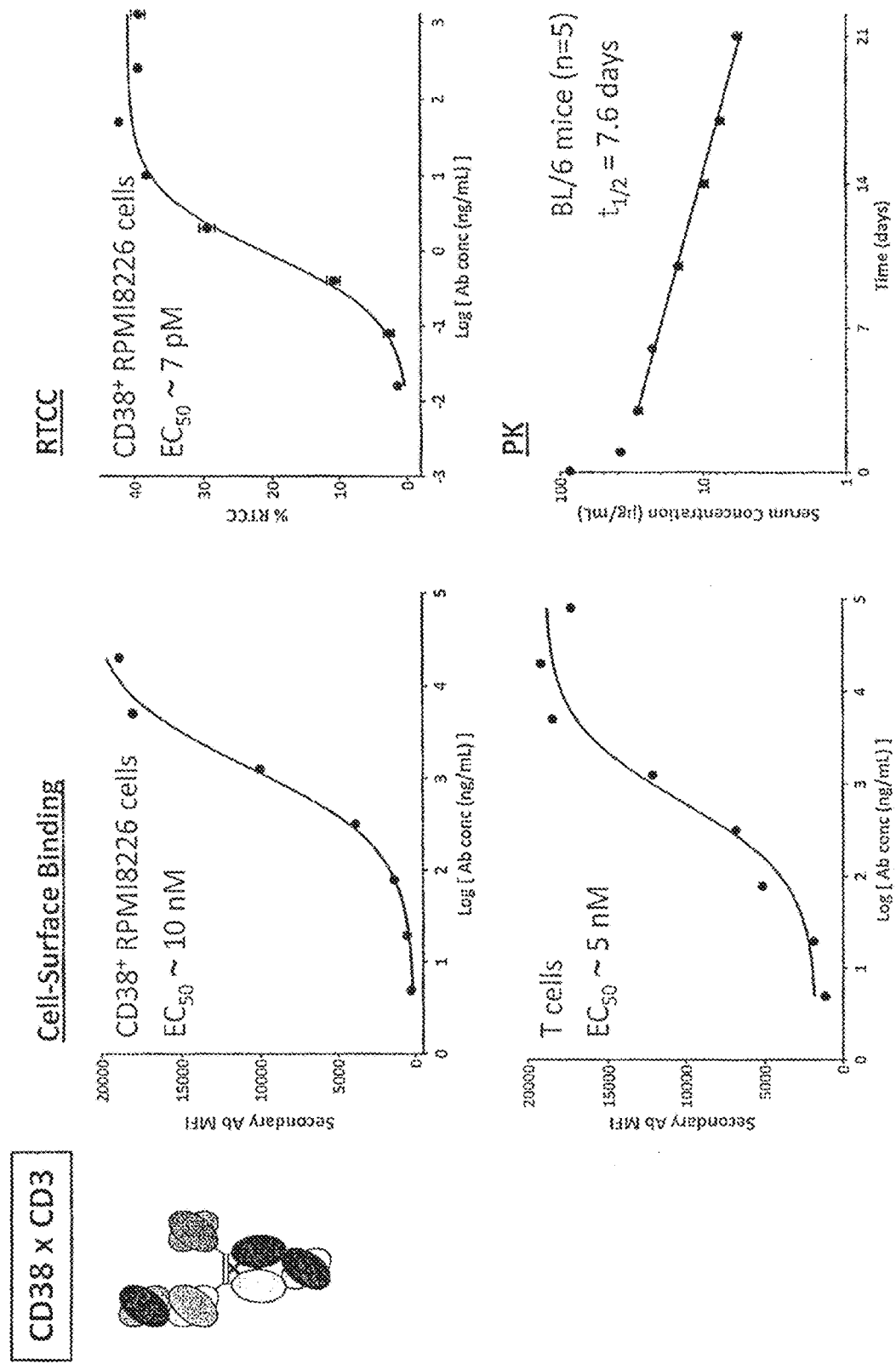
FIGS. 41A and 41B depict the characterization of a "plug and play" combination of existing antibodies with the triple F format.
Figure 41B:
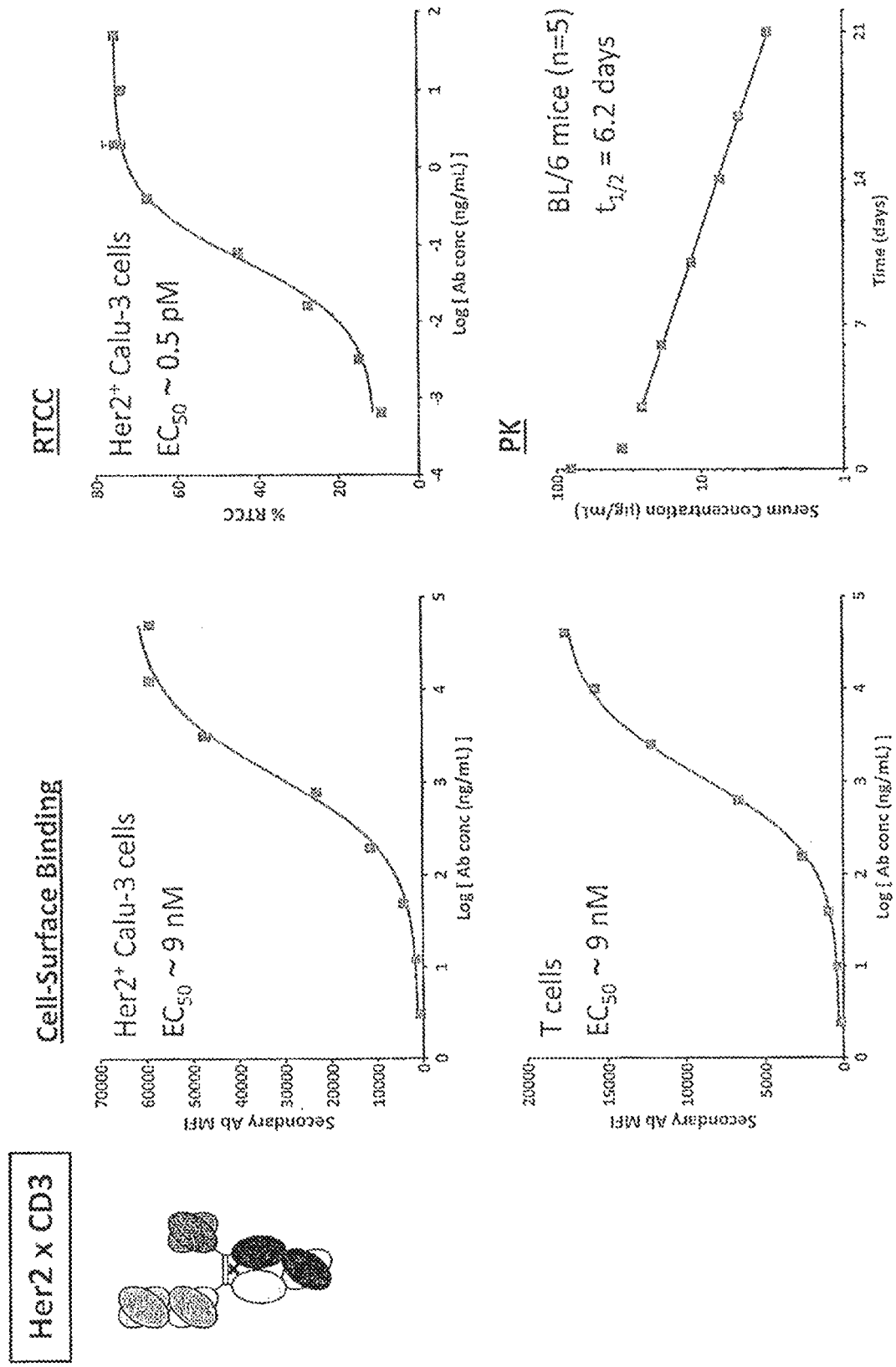
Figure 42:
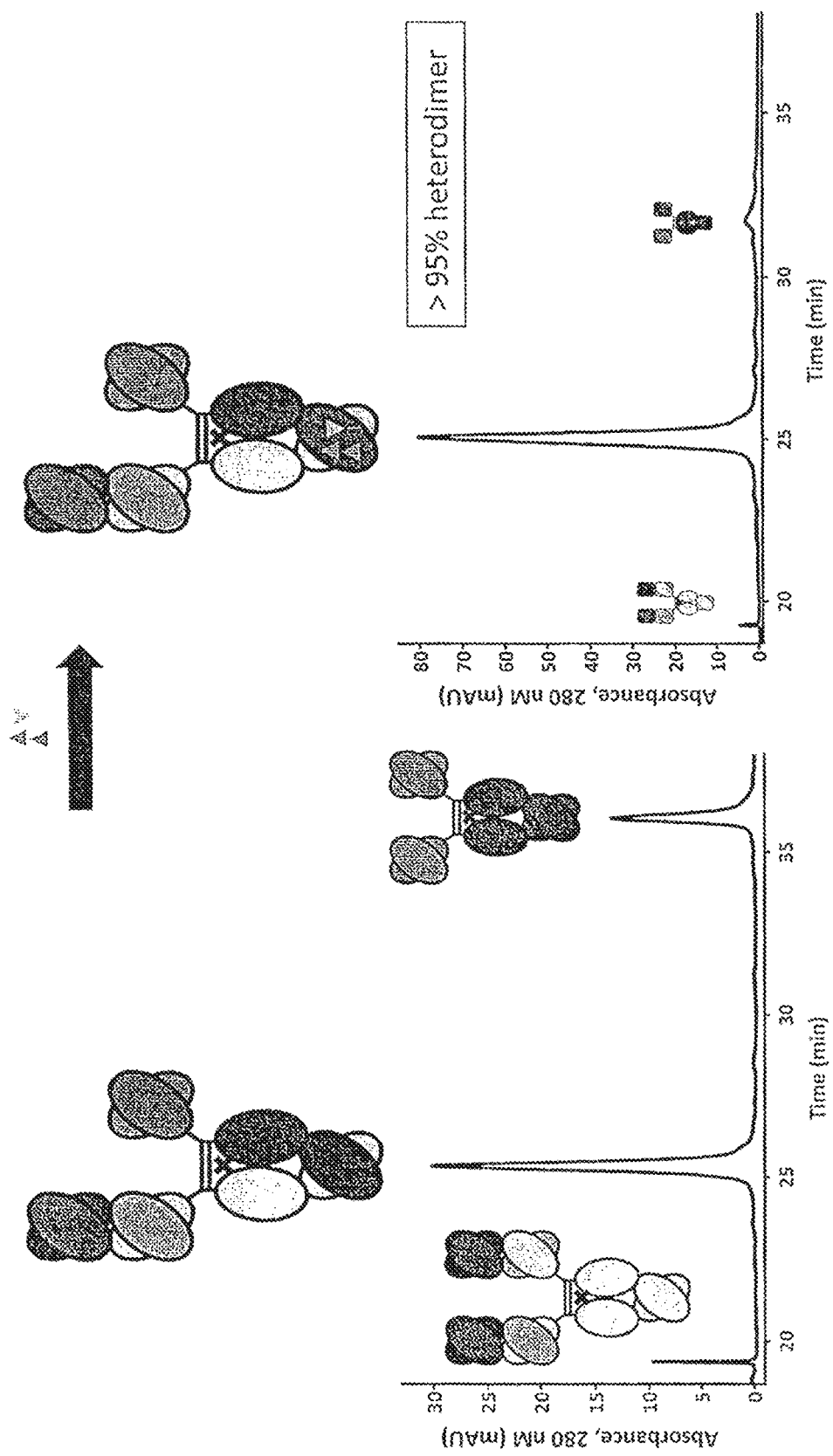
FIG. 42 depicts the remarkable "skew" towards heterodimerization using variants of the invention. Heterodimerization of over 95% was accomplished using one monomer with L368E/K370T and the other with S364K as compared to the same molecule without the Fc variants.
Figure 43:
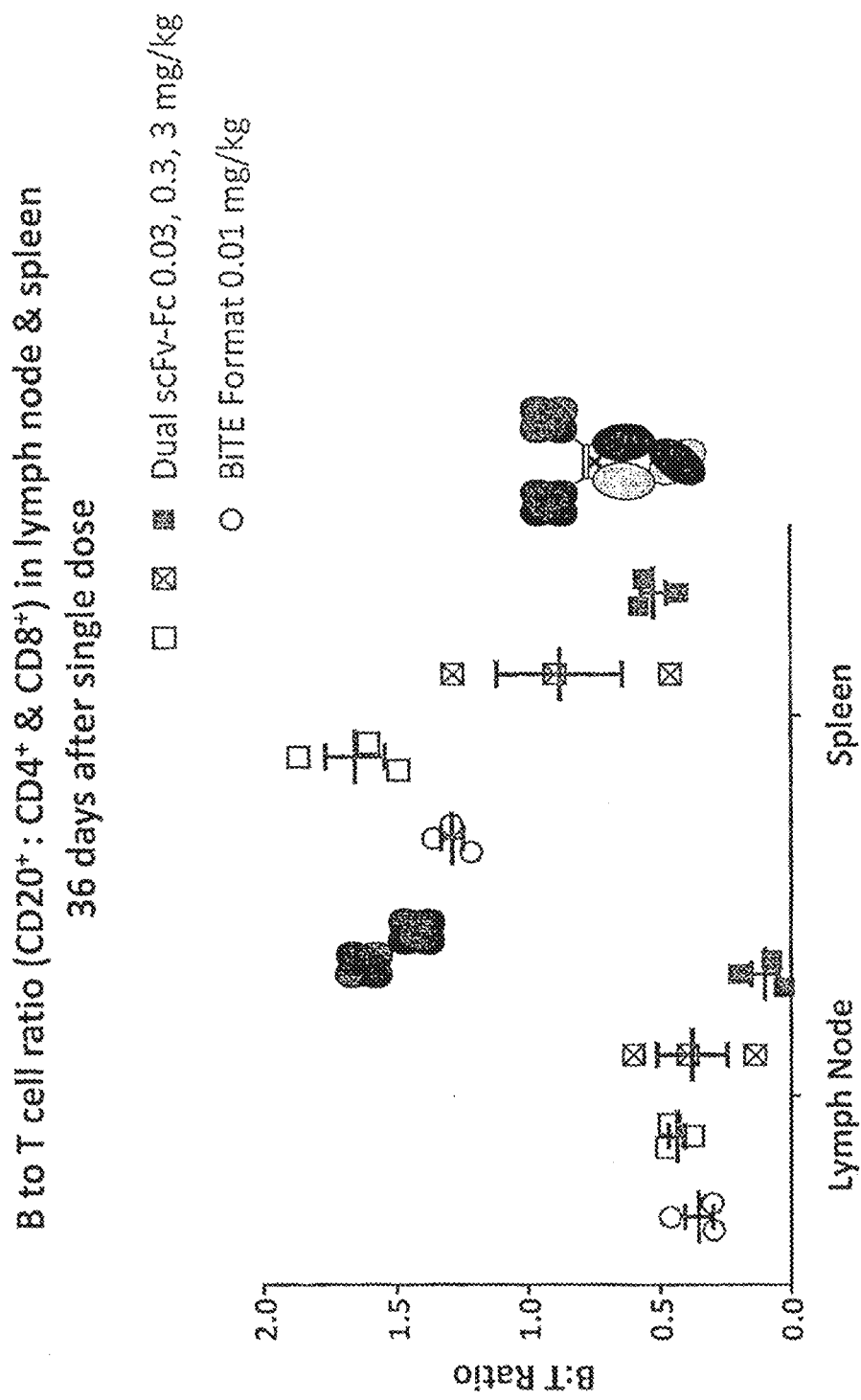
FIG. 43 shows the B cell depletion in cyno monkey lymph nodes and spleen using the dual scFv format as compared to the BiTE format. Single IV bolus in cyno monkeys (n=3).

In one embodiment, the heterodimers of the invention can include amino acid modifications to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41, specifically incorporated herein), Ser. Nos. 11/174,287, 11/396,495, 11/538,406, all of which are expressly incorporated herein by reference in their entirety and specifically for the variants disclosed therein.

Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243L, 236R, 328R, 236R/328R, 298A and 299T. Additional suitable Fc variants are found in FIG. 41 of US 2006/0024298, the figure and legend of which are hereby incorporated by reference in their entirety.

FcRn Modifications

Figures 10A, 10B, 10C, 10D, 10E:
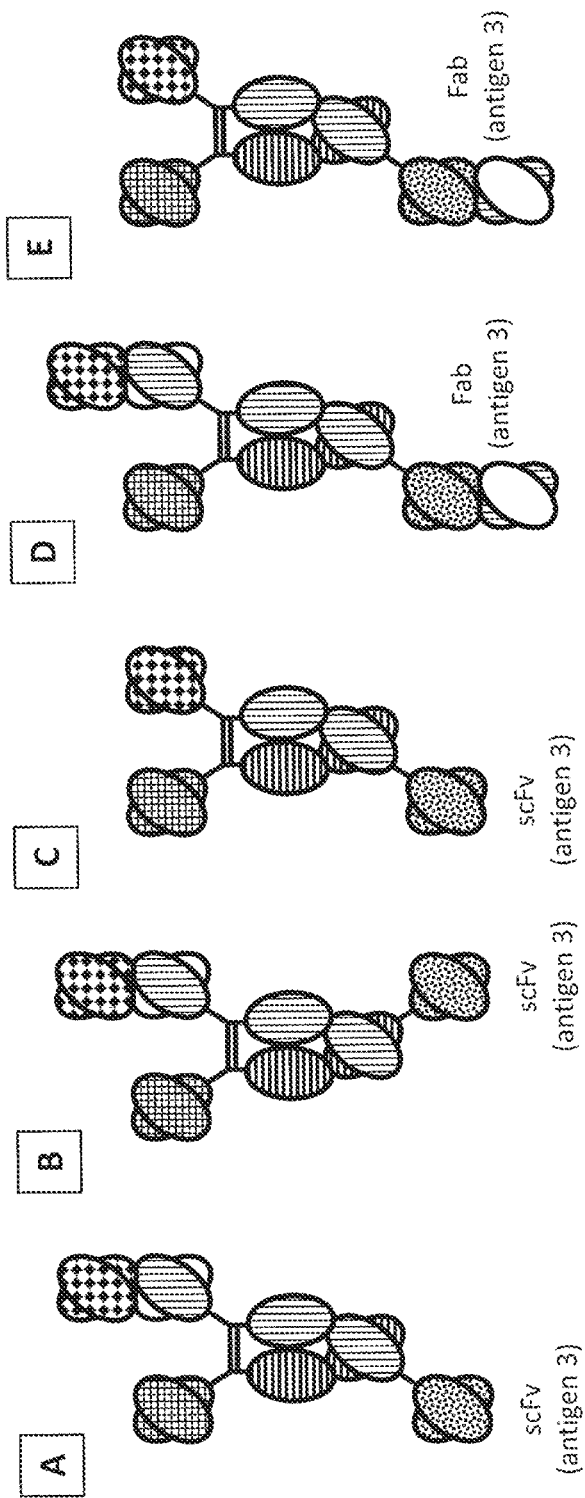
FIGS. 10A-10E depict a variety of "higher multispecificity" embodiments of the "triple F" format.
Figures 11A, 11B, 11C, 11D, 11E:
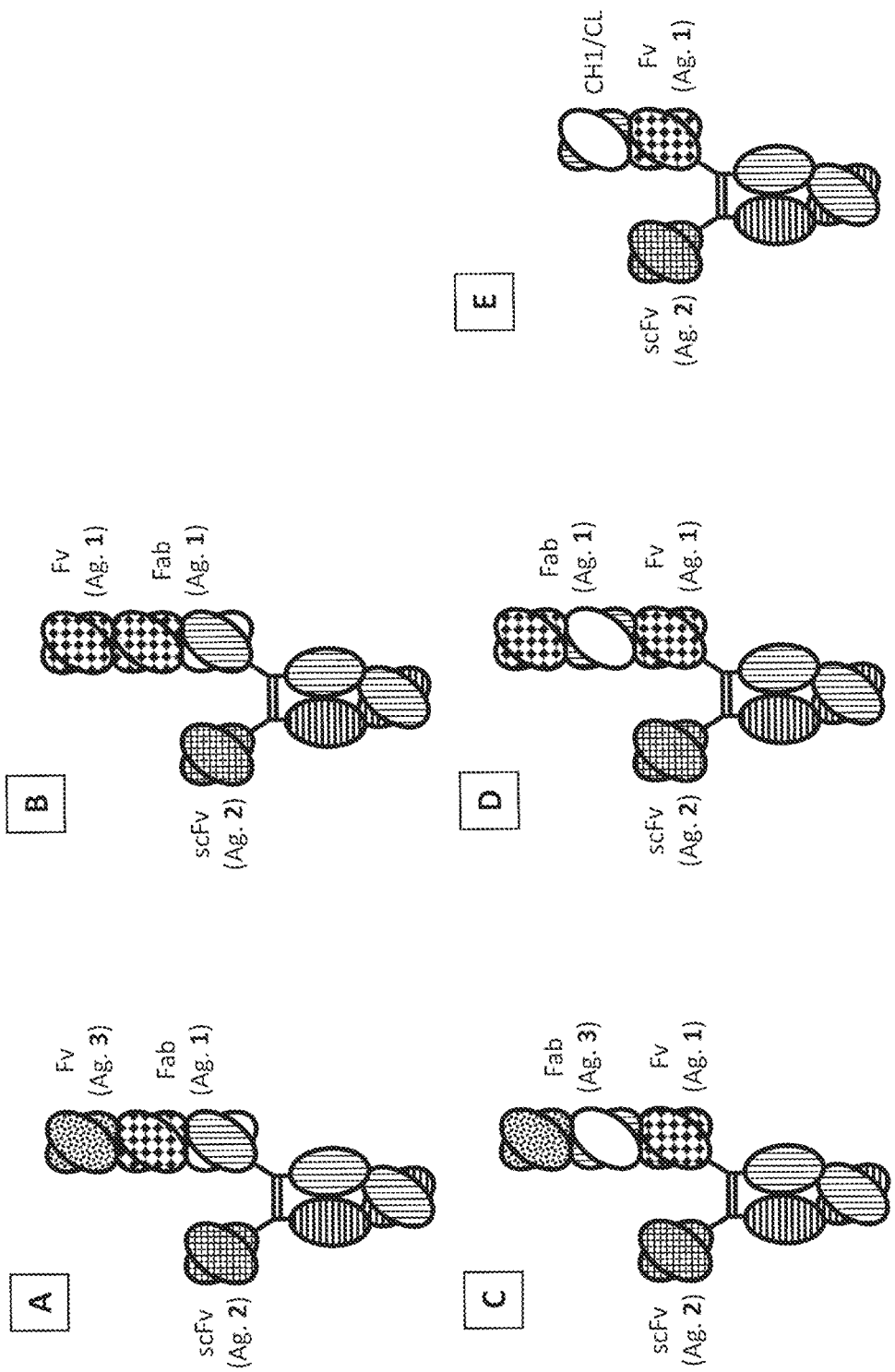
FIGS. 11A-11E show additional varieties of "higher multispecificity" embodiments of the "triple F" format, all with one monomer comprising an scFv.
Figure 16:
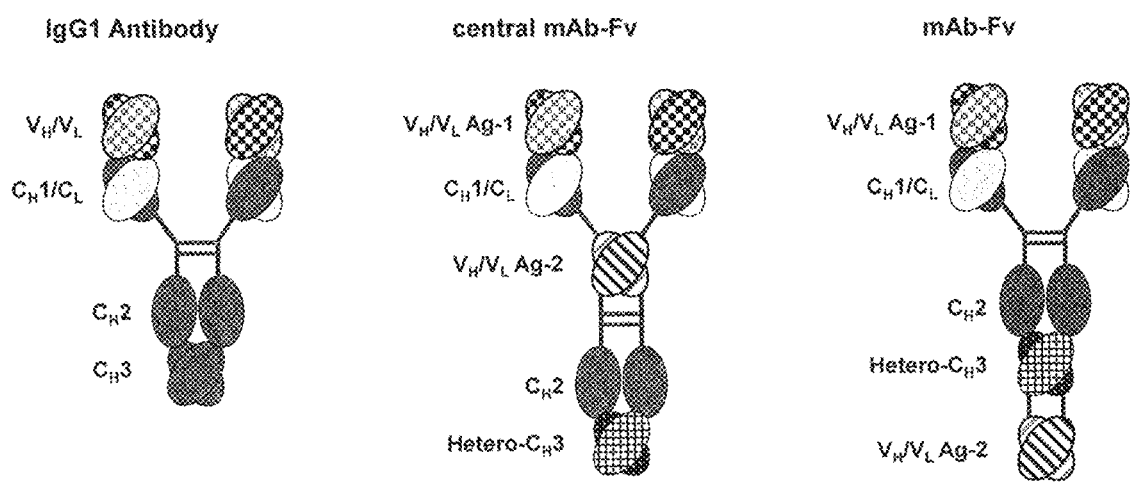
FIG. 16 illustrates the central mAb-Fv immunoglobulin format (sometimes also referred to as "Central mAb"). A native IgG1 antibody and mAb-Fv bispecific are included for reference. Although central mAb-Fv immunoglobulins can be constructed with homodimeric CH3 domains, preferably they utilize heterodimeric CH3 domains, as depicted. Bivalent binding to antigen-1 (Ag-1) is mediated by the N-terminal VH/VL pairs (Fv-1), while monovalent binding to antigen-2 (Ag-2) is mediated by the central VH/VL pair (Fv-2). It should be noted that it is also possible that trimeric valency can be accomplished, where there are two different Fv-1 molecules in the construct, as described below.
Figure 29:
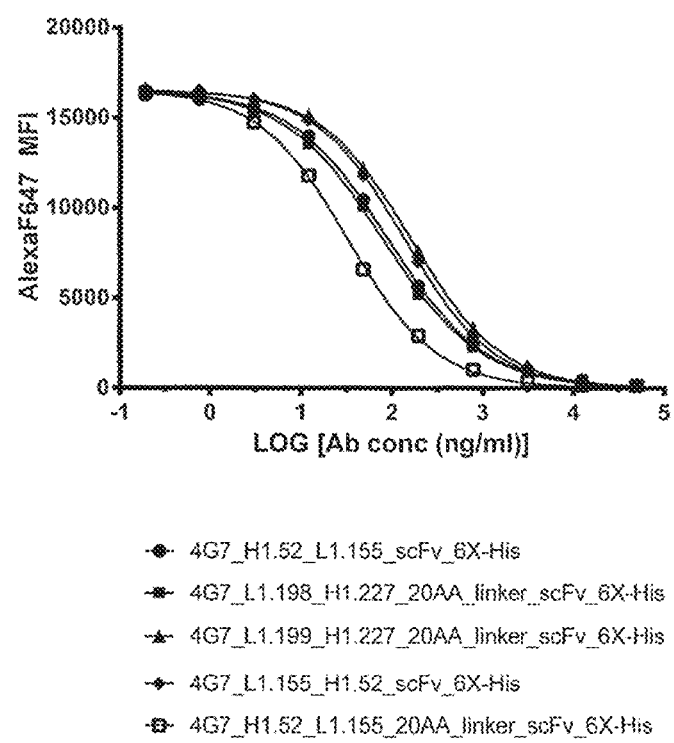
FIG. 29. Stabilized anti-CD19 variable regions—competition binding with labeled anti-CD19 IgG1 @ 1 μg/mL.
Figure 30:
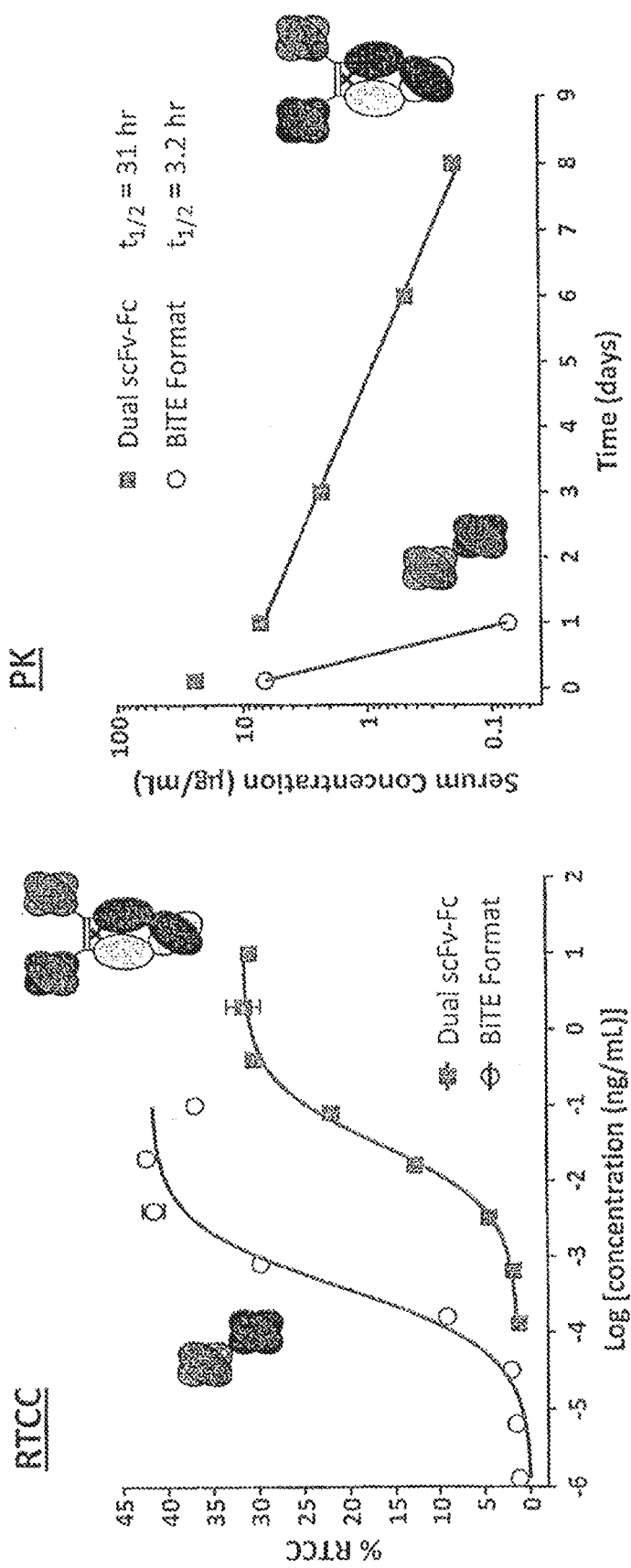
FIG. 30 shows the characterization and comparison of a dual scFv-Fc format, an anti-CD3/anti-CD19 pair, with the "BiTE" format, using the same scFvs but no Fc region. As shown, the dual scFv-Fc is less potent than the BiTE format, but the addition of the Fc region increases the half-life in mice by 10 fold. Data generated using a fluorescent LDH RTCC assay for 24 hours. 10 k Raji cells+400 k T cells, 40:1 E:T ratio. 2 mg/kg IC bolus in hFcRn Tg276 hemizygous BL/6 mice (N=6). 4 of 6 mice BLQ (<70 ng/mL) by 24 hour for BiTE format. Half lives determined in Phoenix WinNonlin 6.1 by non-compartmental analysis.
Figure 31:
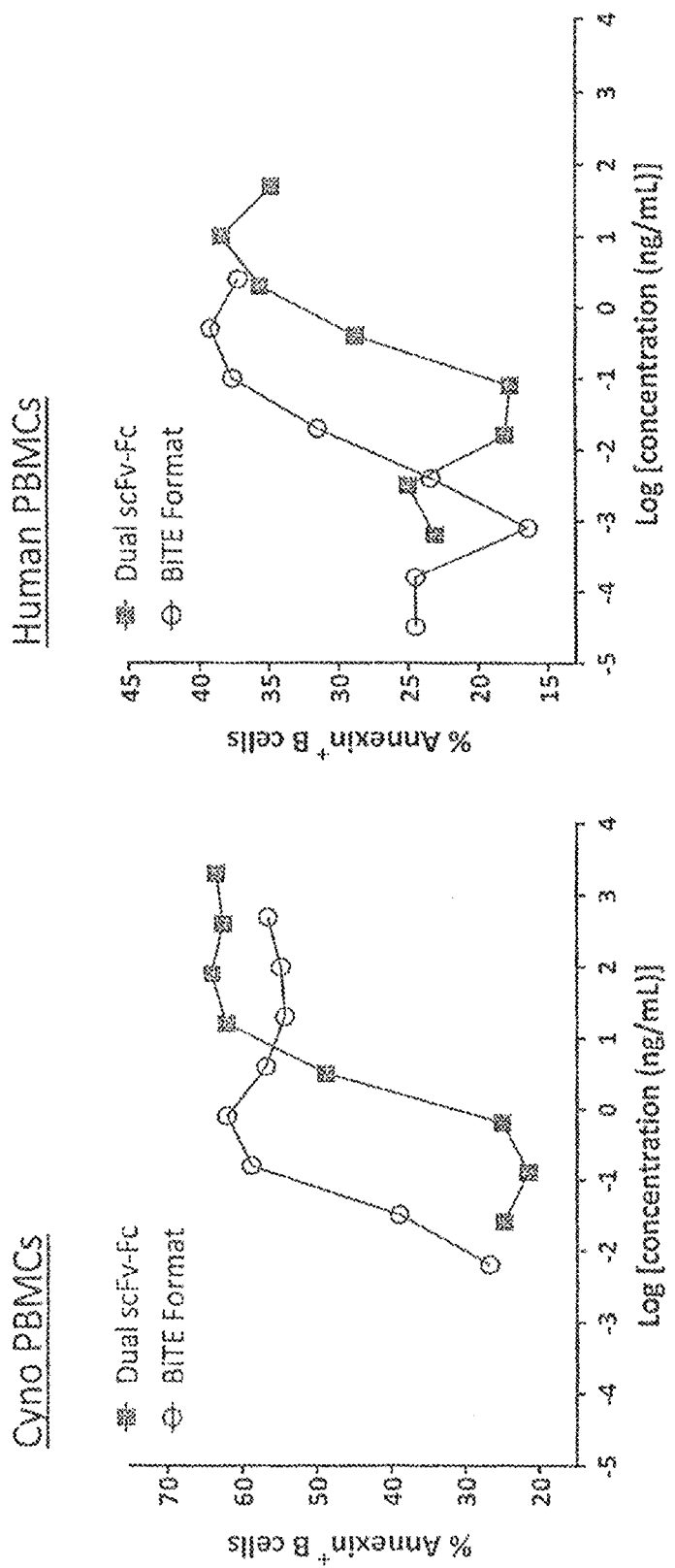
FIG. 31 depicts that the scFv portions each crossreact with cynomolgus monkey antigens in an RTCC test. That is, the potency difference between the formats (dual scFv-Fc versus BiTE) translates into cyno monkeys. The annexin RTCC assay (24 h) on CD20+ B cells in 400 k human or cyno PBMC.
Figure 32:
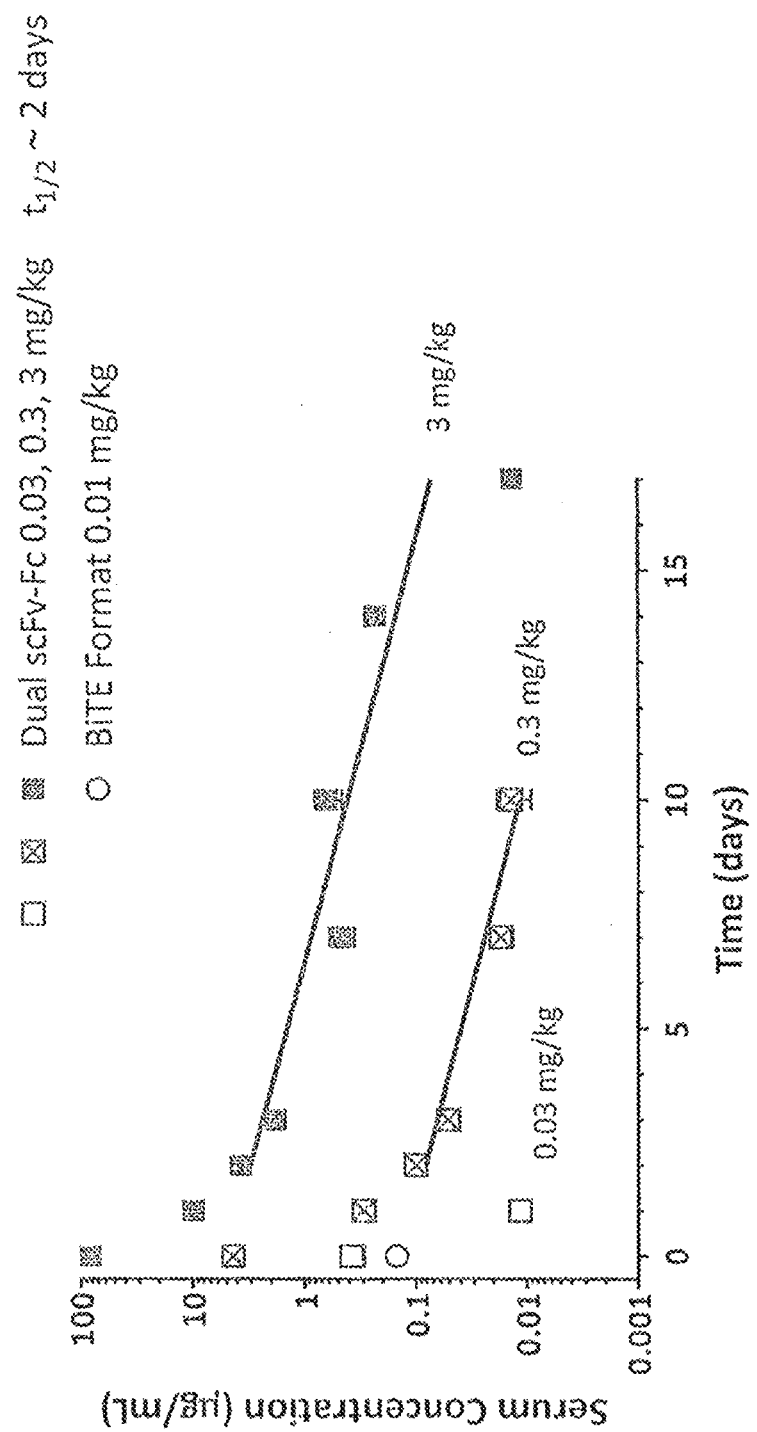
FIG. 32 shows that the half life difference also translates into cyno monkeys as between the two formats. The dual scFv-Fc antibody was run at three different concentrations as shown. The assay was done as a single IV bolus in cyno monkeys (n=3). 3 of 3 cynos BLQ (<2 ng/ml) by 24 hour for BiTE format. Half lives determined in Phoenix WinNonlin 6.1 by non-compartmental analysis.
Figure 33:
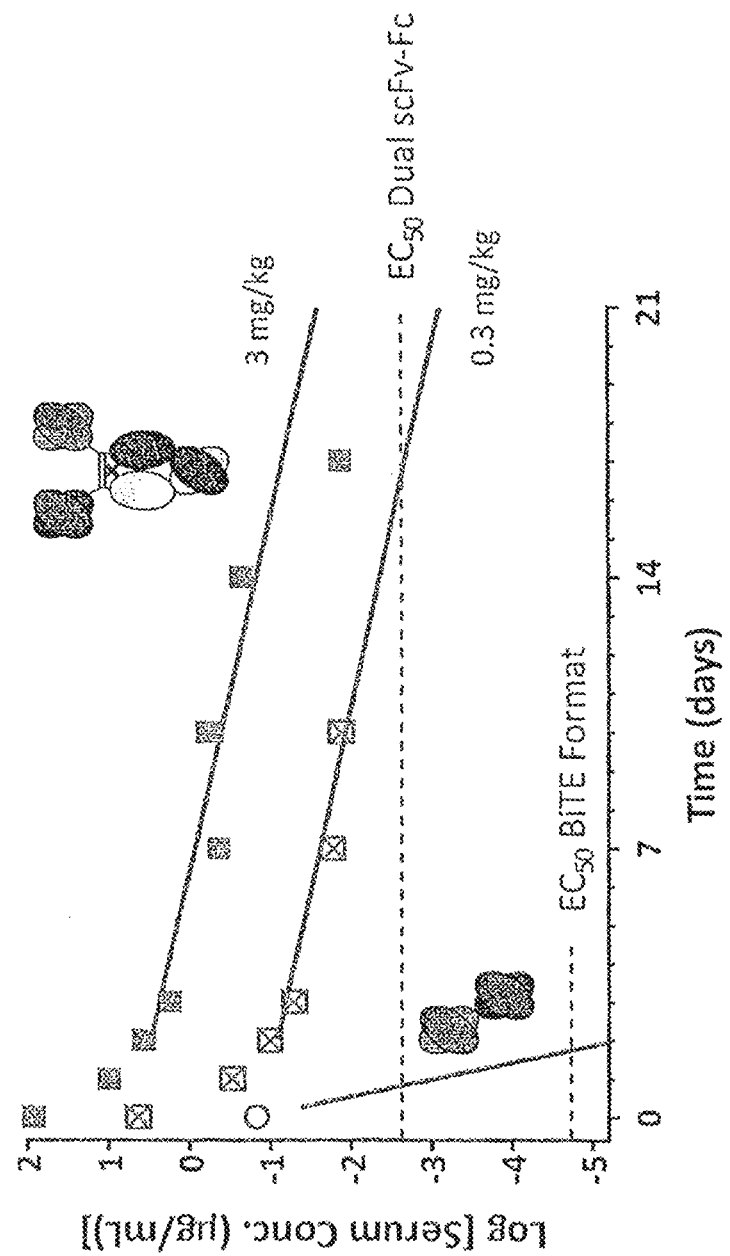
FIG. 33 depicts the projection of pharmacodynamics in monkeys, with the duration of the serum concentration when greater than EC50 is longer for the dual scFv-Fc format than for BiTE, at 2-3 weeks versus 2-3 days.
Figure 34:
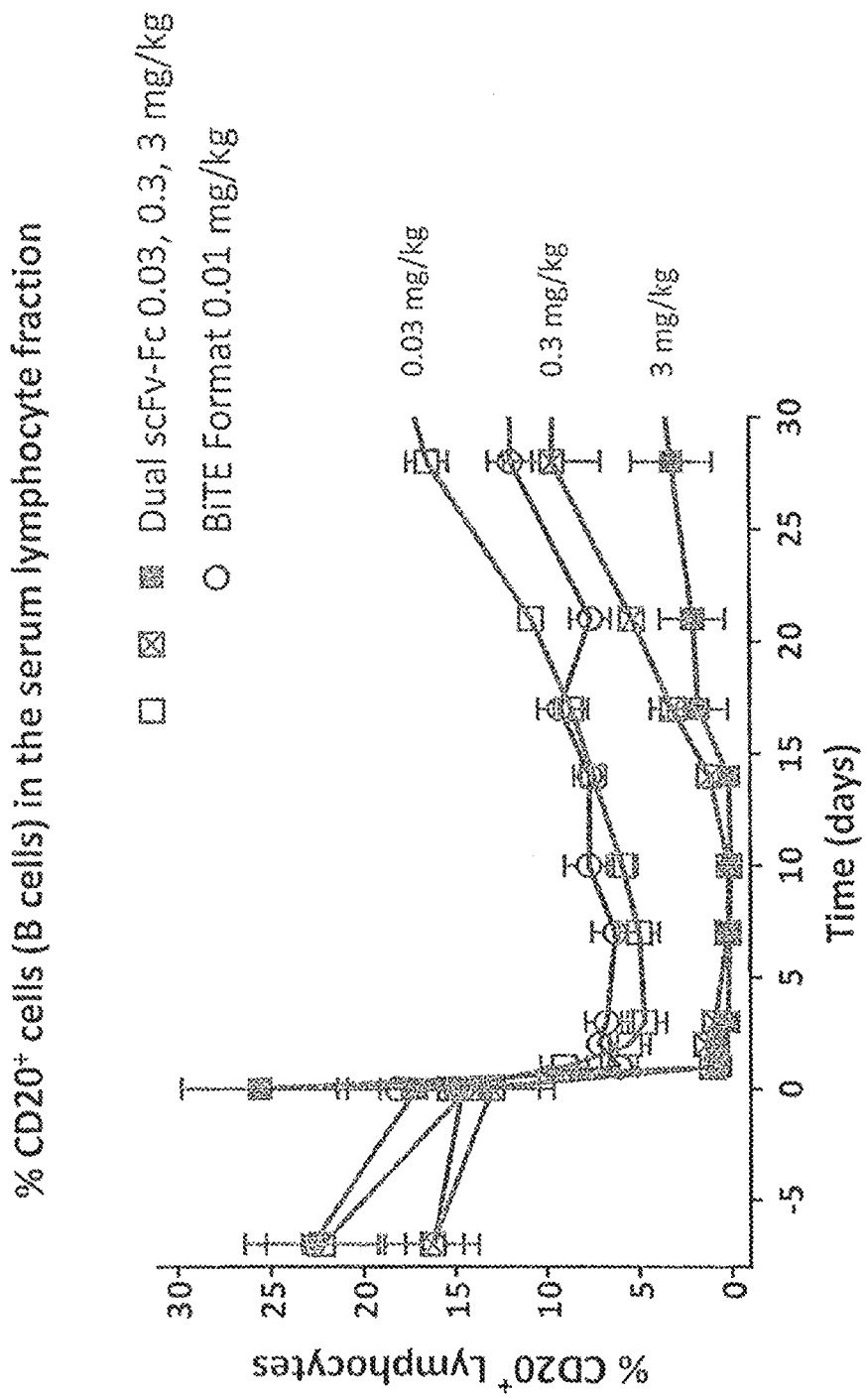
FIG. 34 shows the extensive and prolonged B cell killing with the dual scFv-Fc bispecific format. The longer PK of this format enables prolonged B cell depletion out to 14 days, using a single IV bolus in cyno monkeys (n=3).
Figure 35:
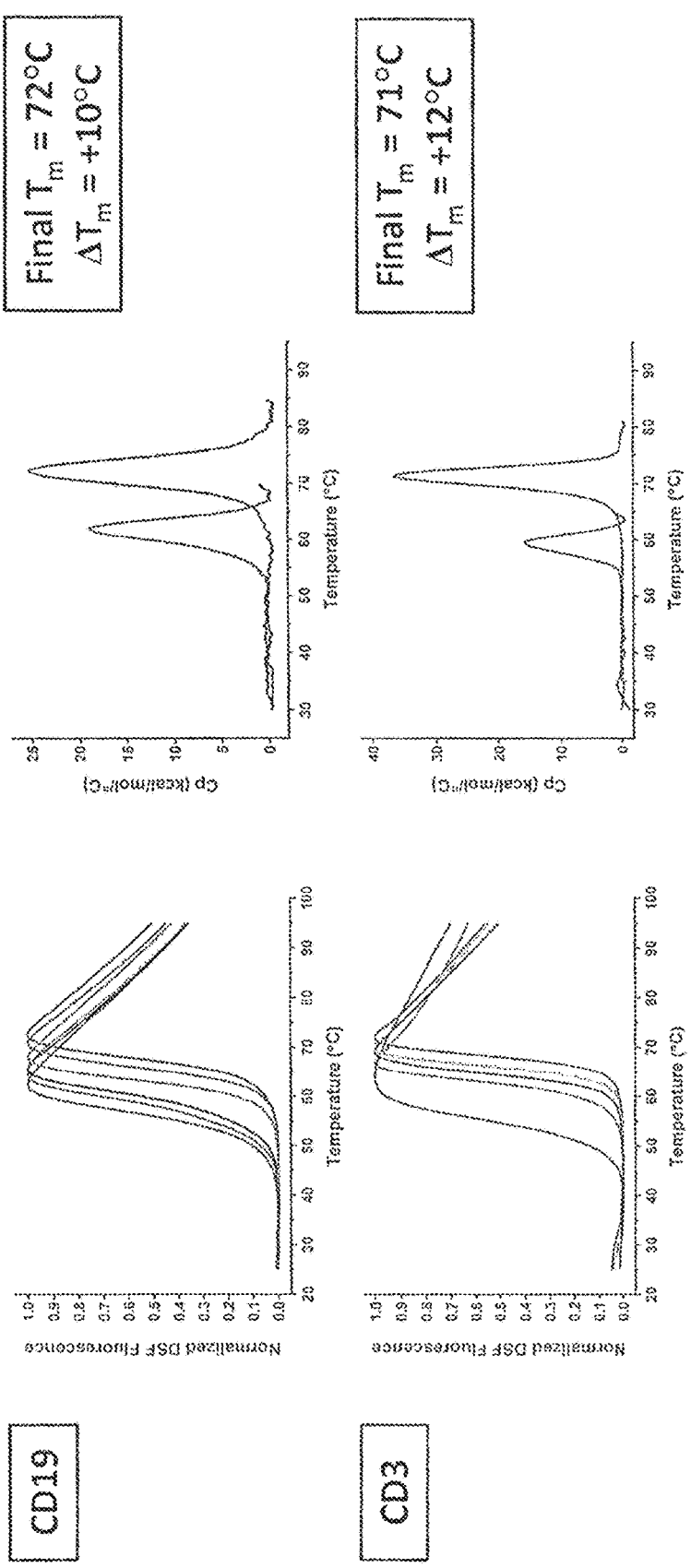
FIG. 35 depicts the stability engineering of the anti-CD3/anti-CD19 scFv-Fc scFv portions. By identifying and replacing rare amino acids, identifying and replacing amino acids with unusual contacting residues, linker engineering and conversion to VL-VH orientation, substantially increased stability was achieved. For CD19, the final Tm=72° C. with a ΔTm=+10° C. For CD3, the final Tm=71° C. with a ΔTm=+12° C.
Figure 36:
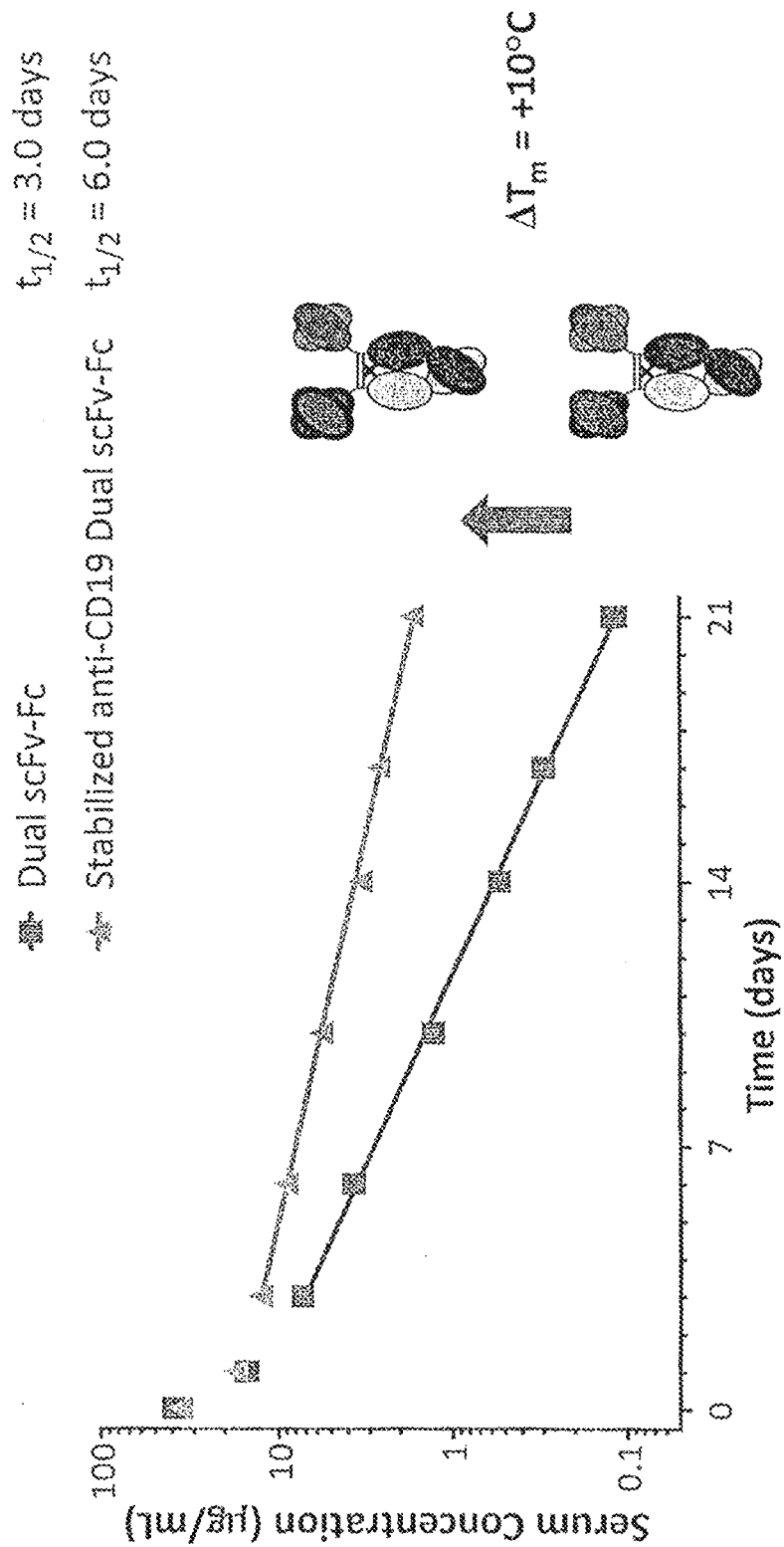
FIG. 36 depicts the improved PK in mice as a result of the stabilization, which resulted in a doubling of the half life in mice for the anti-CD19 stabilization. BL/6 mice (n=5), 2 mg/kg IV dose. Half lives determined in Phoenix WinNonlin 6.1 by non-compartmental analysis.

In addition, there are additional Fc substitutions that find use in increased binding to the FcRn receptor and/or increased serum half life, as specifically disclosed in U.S. Ser. No. 12/341,769, hereby incorporated by reference in its entirety (particularly FIGS. 9 and 10), including, but not limited to, 434S, 434A, 428L, 308F, 259I, 428L/434S, 259I/308F, 436I/428L, 436I or V/434S, 436V/428L, 252Y, 252Y/254T/256E and 259I/308F/428L.

Binding Moieties/Targets

The heterodimeric proteins (for example the heterodimeric immunoglobulins) of the invention include at least a first binding moiety that is an anti-CD3 Fv region (including, as outlined herein, scFv variable regions). As described herein, additional binding moieties (either antibody components such as other Fvs, other scFvs, Fabs, etc.) may target virtually any antigens. As noted above, there are a wide variety of suitable heterodimeric antibody formats, with some preferably co-engage two target antigens, although in some cases, three or four antigens can be engaged.

Combinations that find particular use in a variety of embodiments include heterodimers that bind two antigens: CD3 and an antigen selected from the group consisting of CD5, CD20, CD30, CD33, CD38, CD40, EGFR, EpCAM, Her2 and HM1.24.

Particular suitable applications of the immunoglobulins herein are co-target pairs for which it is beneficial or critical to engage each target antigen monovalently. Such antigens may be, for example, immune receptors that are activated upon immune complexation. Cellular activation of many immune receptors occurs only by cross-linking, acheived typically by antibody/antigen immune complexes, or via effector cell to target cell engagement. For some immune receptors, for example the CD3 signaling receptor on T cells, activation only upon engagement with co-engaged target is critical, as nonspecific cross-linking in a clinical setting can elicit a cytokine storm and toxicity. Therapeutically, by engaging such antigens monovalently rather than multivalently, using the immunoglobulins herein, such activation occurs only in response to cross-linking only in the microenvironment of the primary target antigen. The ability to target two different antigens with different valencies is a novel and useful aspect of the present invention. Examples of target antigens for which it may be therapeutically beneficial or necessary to co-engage monovalently include but are not limited to immune activating receptors such as CD3, FcγRs, toll-like receptors (TLRs) such as TLR4 and TLR9, cytokine, chemokine, cytokine receptors, and chemokine receptors.

Virtually any antigen may be targeted by the immunoglobulins herein, including but not limited to proteins, subunits, domains, motifs, and/or epitopes belonging to the following list of target antigens, which includes both soluble factors such as cytokines and membrane-bound factors, including transmembrane receptors: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RIIB, ADAM, ADAM10, ADAM12, ADAM15, ADAM17/TACE, ADAMS, ADAMS, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 Osteogenin, BMP-4 BMP-2b, BMP-5, BMP-6 Vgr-1, BMP-7 (OP)-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, C10, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, *Clostridium* botulinum toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-1 (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, Enkephalinase, eNOS, Eot, eotaxinl, EpCAM, Ephrin B2/EphB4, EPO, ERCC, E-selectin, ET-1, Factor IIa, Factor VII, Factor VIIIc, Factor IX, fibroblast activation protein (FAP), Fas, FcR1, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein Hb/IIIa (GP Hb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gp120, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-I1, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin alpha4/beta7, integrin alpha5 (alphaV), integrin alpha5/beta1, integrin alpha5/beta3, integrin alpha6, integrin beta1, integrin beta2, interferon gamma, IP-10,1-TAC, JE, Kallikrein 2, Kallikrein 5, Kallikrein 6, Kallikrein 11, Kallikrein 12, Kallikrein 14, Kallikrein 15, Kallikrein L1, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bpl, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Mucl), MUC18, Muellerian-inhibitin substance, Mug, MuSK, NAIP, NAP, NCAD, N-Cadherin, NCA 90, NCAM, NCAM, Neprilysin, Neurotrophin-3,-4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), P1GF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, 5100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEMS, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta RIIb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL R1 TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSF1A (TNF-α Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (flt-1), VEGF, VEGFR, VEGFR-3 (flt-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, and receptors for hormones and growth factors. To form the bispecific or trispecific antibodies of the invention, antibodies to any combination of these antigens can be made; that is, each of these antigens can be optionally and independently included or excluded from a multispecific antibody according to the present invention.

Exemplary antigens that may be targeted specifically by the immunoglobulins of the invention include but are not limited to: CD20, CD19, Her2, EGFR, EpCAM, CD3, FcγRIIIa (CD16), FcγRIIa (CD32a), FcγRIIb (CD32b), FcγRI (CD64), Toll-like receptors (TLRs) such as TLR4 and TLR9, cytokines such as IL-2, IL-5, IL-13, IL-12, IL-23, and TNFα, cytokine receptors such as IL-2R, chemokines, chemokine receptors, growth factors such as VEGF and HGF, and the like. To form the bispecific or trispecific antibodies of the invention, antibodies to any combination of these antigens can be made; that is, each of these antigens can be optionally and independently included or excluded from a multispecific antibody according to the present invention.

The choice of suitable target antigens and co-targets depends on the desired therapeutic application. Some targets that have proven especially amenable to antibody therapy are those with signaling functions. Other therapeutic antibodies exert their effects by blocking signaling of the receptor by inhibiting the binding between a receptor and its cognate ligand. Another mechanism of action of therapeutic antibodies is to cause receptor down regulation. Other antibodies do not work by signaling through their target antigen. The choice of co-targets will depend on the detailed biology underlying the pathology of the indication that is being treated.

Monoclonal antibody therapy has emerged as an important therapeutic modality for cancer (Weiner et al., 2010, Nature Reviews Immunology 10:317-327; Reichert et al., 2005, Nature Biotechnology 23[9]:1073-1078; herein expressly incorporated by reference). For anti-cancer treatment it may be desirable to target one antigen (antigen-1) whose expression is restricted to the cancerous cells while co-targeting a second antigen (antigen-2) that mediates some immunological killing activity. For other treatments it may be beneficial to co-target two antigens, for example two angiogenic factors or two growth factors, that are each known to play some role in proliferation of the tumor. Exemplary co-targets for oncology include but are not limited to HGF and VEGF, IGF-1R and VEGF, Her2 and VEGF, CD19 and CD3, CD20 and CD3, Her2 and CD3, CD19 and FcγRIIIa, CD20 and FcγRIIIa, Her2 and FcγRIIIa. An immunoglobulin of the invention may be capable of binding VEGF and phosphatidylserine; VEGF and ErbB3; VEGF and PLGF; VEGF and ROBO4; VEGF and BSG2; VEGF and CDCP1; VEGF and ANPEP; VEGF and c-MET; HER-2 and ERB3; HER-2 and BSG2; HER-2 and CDCP1; HER-2 and ANPEP; EGFR and CD64; EGFR and BSG2; EGFR and CDCP1; EGFR and ANPEP; IGF1R and PDGFR; IGF1R and VEGF; IGF1R and CD20; CD20 and CD74; CD20 and CD30; CD20 and DR4; CD20 and VEGFR2; CD20 and CD52; CD20 and CD4; HGF and c-MET; HGF and NRP1; HGF and phosphatidylserine; ErbB3 and IGF1R; ErbB3 and IGF1,2; c-Met and Her-2; c-Met and NRP1; c-Met and IGF1R; IGF1,2 and PDGFR; IGF1,2 and CD20; IGF1,2 and IGF1R; IGF2 and EGFR; IGF2 and HER2; IGF2 and CD20; IGF2 and VEGF; IGF2 and IGF1R; IGF1 and IGF2; PDGFRa and VEGFR2; PDGFRa and PLGF; PDGFRa and VEGF; PDGFRa and c-Met; PDGFRa and EGFR; PDGFRb and VEGFR2; PDGFRb and c-Met; PDGFRb and EGFR; RON and c-Met; RON and MTSP1; RON and MSP; RON and CDCP1; VGFR1 and PLGF; VGFR1 and RON; VGFR1 and EGFR; VEGFR2 and PLGF; VEGFR2 and NRP1; VEGFR2 and RON; VEGFR2 and DLL4; VEGFR2 and EGFR; VEGFR2 and ROBO4; VEGFR2 and CD55; LPA and S1P; EPHB2 and RON; CTLA4 and VEGF; CD3 and EPCAM; CD40 and IL6; CD40 and IGF; CD40 and CD56; CD40 and CD70; CD40 and VEGFR1; CD40 and DR5; CD40 and DR4; CD40 and APRIL; CD40 and BCMA; CD40 and RANKL; CD28 and MAPG; CD80 and CD40; CD80 and CD30; CD80 and CD33; CD80 and CD74; CD80 and CD2; CD80 and CD3; CD80 and CD19; CD80 and CD4; CD80 and CD52; CD80 and VEGF; CD80 and DR5; CD80 and VEGFR2; CD22 and CD20; CD22 and CD80; CD22 and CD40; CD22 and CD23; CD22 and CD33; CD22 and CD74; CD22 and CD19; CD22 and DR5; CD22 and DR4; CD22 and VEGF; CD22 and CD52; CD30 and CD20; CD30 and CD22; CD30 and CD23; CD30 and CD40; CD30 and VEGF; CD30 and CD74; CD30 and CD19; CD30 and DR5; CD30 and DR4; CD30 and VEGFR2; CD30 and CD52; CD30 and CD4; CD138 and RANKL; CD33 and FTL3; CD33 and VEGF; CD33 and VEGFR2; CD33 and CD44; CD33 and DR4; CD33 and DR5; DR4 and CD137; DR4 and IGF1,2; DR4 and IGF1R; DR4 and DR5; DR5 and CD40; DR5 and CD137; DR5 and CD20; DR5 and EGFR; DR5 and IGF1,2; DR5 and IGFR, DR5 and HER-2, and EGFR and DLL4. Other target combinations include one or more members of the EGF/erb-2/erb-3 family.

Other targets (one or more) involved in oncological diseases that the immunoglobulins herein may bind include, but are not limited to those selected from the group consisting of: CD52, CD20, CD19, CD3, CD4, CD8, BMP6, IL12A, IL1A, IL1B, IL2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, IL2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO1, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR1I3, NR2F6, NR4A3, ESR1, ESR2, NROB1, NROB2, NR1D2, NR1H2, NR1H4, NR1I2, NR2C1, NR2C2, NR2E1, NR2E3, NR2F1, NR2F2, NR3C1, NR3C2, NR4A1, NR4A2, NR5A1, NR5A2, NR6 μl, PGR, BARB, FGF1, FGF2, FGF6, KLK3, KRT1, APOC1, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, IL2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH20, CDH7, CDH9, CDH1, CDH10, CDH13, CDH18, CDH19, CDH20, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB21P, DES, DNCL1, ELAC2, EN02, EN03, FASN, FLJ12584, F1125530, GAGEB1, GAGEC1, GGT1, GSTP1, HIP1, HUMCYT2A, IL29, K6HF, KAII, KRT2A, MIB1, PART1, PATE, PCA3, PIAS2, PIK3CG, PPID, PR1, PSCA, SLC2A2, SLC33 µl, SLC43 µl, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMA5, NRP1, NRP2, PGF, PLXDC1, STAB 1, VEGF, VEGFC, ANGPTL3, BAIL COL4A3, IL8, LAMA5, NRP1, NRP2, STAB 1, ANGPTL4, PECAM1, PF4, PROK2, SERPINF1, TNFAIP2, CCL11, CCL2, CXCL1, CXCL10, CXCL3, CXCL5, CXCL6, CXCL9, IFNA1, IFNB1, IFNG, IL1B, IL6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL1A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kip1), CDKN2A (p16INK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K7 (c-Jun), MKI67 (Ki-67), NGFB (GF), NGFR, NME1 (M23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase Iia), TP53, AZGP1 (zinc-a-glycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Spr1), THBS1, THBS2, THBS4, and TNFAIP2 (B94), RON, c-Met, CD64, DLL4, PLGF, CTLA4, phophatidylserine, ROBO4, CD80, CD22, CD40, CD23, CD28, CD80, CD55, CD38, CD70, CD74, CD30, CD138, CD56, CD33, CD2, CD137, DR4, DR5, RANKL, VEGFR2, PDGFR, VEGFR1, MTSP1, MSP, EPHB2, EPHA1, EPHA2, EpCAM, PGE2, NKG2D, LPA, SIP, APRIL, BCMA, MAPG, FLT3, PDGFR alpha, PDGFR beta, ROR1, PSMA, PSCA, SCD1, and CD59. To form the bispecific or trispecific antibodies of the invention, antibodies to any combination of these antigens can be made; that is, each of these antigens can be optionally and independently included or excluded from a multispecific antibody according to the present invention.

Monoclonal antibody therapy has become an important therapeutic modality for treating autoimmune and inflammatory disorders (Chan & Carter, 2010, Nature Reviews Immunology 10:301-316; Reichert et al., 2005, Nature Biotechnology 23[9]:1073-1078; herein expressly incorporated by reference). Many proteins have been implicated in general autoimmune and inflammatory responses, and thus may be targeted by the immunogloublins of the invention. Autoimmune and inflammatory targets include but are not limited to C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp-1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (1-TAC/IP-9), CXCL12 (SDF1), CXCL13, CXCL14, CXCL2, CXCL3, CXCL5 (ENA-78/LIX), CXCL6 (GCP-2), CXCL9, IL13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL5RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GFI1, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL6ST, IL7, IL8, IL8RA, IL8RB, IL9, IL9R, IL10, IL10RA, IL10RB, IL11, IL12RA, IL12A, IL12B, IL12RB1, IL12RB2, IL13, IL13RA1, IL13RA2, IL15, IL15RA, IL16, IL17, IL17R, IL18, IL18R1, IL19, IL20, KITLG, LEP, LTA, LTB, LTB4R, LTB4R2, LTBR, MIF, NPPB, PDGFB, TBX21, TDGF1, TGFA, TGFB1, TGFB1I1, TGFB2, TGFB3, TGFB1, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144). To form the bispecific or trispecific antibodies of the invention, antibodies to any combination of these antigens can be made; that is, each of these antigens can be optionally and independently included or excluded from a multispecific antibody according to the present invention.

Exemplary co-targets for autoimmune and inflammatory disorders include but are not limited to IL-1 and TNFalpha, IL-6 and TNFalpha, IL-6 and IL-1, IgE and IL-13, IL-1 and IL-13, IL-4 and IL-13, IL-5 and IL-13, IL-9 and IL-13, CD19 and FcγRIIb, and CD79 and FcγRIIb.

Immunglobulins of the invention with specificity for the following pairs of targets to treat inflammatory disease are contemplated: TNF and IL-17A; TNF and RANKL; TNF and VEGF; TNF and SOST; TNF and DKK; TNF and alphaVbeta3; TNF and NGF; TNF and IL-23p19; TNF and IL-6; TNF and SOST; TNF and IL-6R; TNF and CD-20; IgE and IL-13; IL-13 and IL23p19; IgE and IL-4; IgE and IL-9; IgE and IL-9; IgE and IL-13; IL-13 and IL-9; IL-13 and IL-4; IL-13 and IL-9; IL-13 and IL-9; IL-13 and IL-4; IL-13 and IL-23p19; IL-13 and IL-9; IL-6R and VEGF; IL-6R and IL-17A; IL-6R and RANKL; IL-17A and IL-lbeta; IL-1beta and RANKL; IL-1beta and VEGF; RANKL and CD-20; IL-1alpha and IL-lbeta; IL-1alpha and IL-1beta.

Pairs of targets that the immunoglobulins described herein can bind and be useful to treat asthma may be determined. In an embodiment, such targets include, but are not limited to, IL-13 and IL-1beta, since IL-1beta is also implicated in inflammatory response in asthma; IL-13 and cytokines and chemokines that are involved in inflammation, such as IL-13 and IL-9; IL-13 and IL-4; IL-13 and IL-5; IL-13 and IL-25; IL-13 and TARC; IL-13 and MDC; IL-13 and MIF; IL-13 and TGF-β; IL-13 and LHR agonist; IL-13 and CL25; IL-13 and SPRR2a; IL-13 and SPRR2b; and IL-13 and ADAMS. The immunoglobulins herein may have specifity for one or more targets involved in asthma selected from the group consisting of CSF1 (MCSF), CSF2 (GM-CSF), CSF3 (GCSF), FGF2, IFNA1, IFNB1, IFNG, histamine and histamine receptors, IL1A, IL1B, IL2, IL3, IL4, IL5, IL6, IL7, IL8, IL9, IL10, IL11, IL12A, IL12B, IL13, IL14, IL15, IL16, IL17, IL18, IL19, KITLG, PDGFB, IL2RA, IL4R, IL5RA, IL8RA, IL8RB, IL12RB1, IL12RB2, IL13RA1, IL13RA2, IL18R1, TSLP, CCLi, CCL2, CCL3, CCL4, CCL5, CCL7, CCL8, CCL13, CCL17, CCL18, CCL19, CCL20, CCL22, CCL24, CX3CL1, CXCL1, CXCL2, CXCL3, XCLi, CCR2, CCR3, CCR4, CCR5, CCR6, CCR7, CCR8, CX3CR1, GPR2, XCR1, FOS, GATA3, JAK1, JAK3, STAT6, TBX21, TGFB1, TNF, TNFSF6, YY1, CYSLTR1, FCER1A, FCER2, LTB4R, TB4R2, LTBR, and Chitinase. To form the bispecific or trispecific antibodies of the invention, antibodies to any combination of these antigens can be made; that is, each of these antigens can be optionally and independently included or excluded from a multispecific antibody according to the present invention.

Pairs of targets involved in rheumatoid arthritis (RA) may be co-targeted by the invention, including but not limited to TNF and IL-18; TNF and IL-12; TNF and IL-23; TNF and IL-1beta; TNF and MIF; TNF and IL-17; and TNF and IL-15.

Antigens that may be targeted in order to treat systemic lupus erythematosus (SLE) by the immunoglobulins herein include but are not limited to CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGSI, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, ILIR2, ITGA2, ITGA3, MS4A1, ST6GALI, CDIC, CHSTIO, HLA-A, HLA-DRA, and NT5E.; CTLA4, B7.1, B7.2, BlyS, BAFF, C5, IL-4, IL-6, IL-10, IFN-α, and TNF-α. To form the bispecific or trispecific antibodies of the invention, antibodies to any combination of these antigens can be made; that is, each of these antigens can be optionally and independently included or excluded from a multispecific antibody according to the present invention.

The immunoglobulins herein may target antigens for the treatment of multiple sclerosis (MS), inlcuding but not limited to IL-12, TWEAK, IL-23, CXCL13, CD40, CD40L, IL-18, VEGF, VLA-4, TNF, CD45RB, CD200, IFNgamma, GM-CSF, FGF, C5, CD52, and CCR2. An embodiment includes co-engagement of anti-IL-12 and TWEAK for the treatment of MS.

One aspect of the invention pertains to immunoglobulins capable of binding one or more targets involved in sepsis, in an embodiment two targets, selected from the group consisting TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFκB1, PROC, TNFRSFIA, CSF3, CCR3, ILIRN, MIF, NFκB1, PTAFR, TLR2, TLR4, GPR44, HMOX1, midkine, IRAK1, NFκB2, SERPINA1, SERPINE1, and TREM1. To form the bispecific or trispecific antibodies of the invention, antibodies to any combination of these antigens can be made; that is, each of these antigens can be optionally and independently included or excluded from a multispecific antibody according to the present invention.

In some cases, immunoglobulins herein may be directed against antigens for the treatment of infectious diseases.

Antibodies for Engineering

In some embodiments, the heterodimeric engineering and multispecific engineering described herein is done with portions of therapeutic antibodies. A number of antibodies that are approved for use, in clinical trials, or in development may benefit from the pI variants of the present invention. These antibodies are herein referred to as "clinical products and candidates". Thus in a preferred embodiment, the heterodimerization variants may find use in a range of clinical products and candidates. For example the heterodimerization variants of the present invention may find use in an antibody that has an anti-CD3 variable region and then another antibody components, e.g. the variable domains, the CDRs, etc., of clinical antibodies including, but not limited to, rituximab (Rituxan®, IDEC/Genentech/Roche) (see for example U.S. Pat. No. 5,736,137), a chimeric anti-CD20 antibody approved to treat Non-Hodgkin's lymphoma; HuMax-CD20, an anti-CD20 currently being developed by Genmab, an anti-CD20 antibody described in U.S. Pat. No. 5,500,362, AME-133 (Applied Molecular Evolution), hA20 (Immunomedics, Inc.), HumaLYM (Intracel), and PRO70769 (PCT/US2003/040426, entitled "Immunoglobulin Variants and Uses Thereof"). A number of antibodies that target members of the family of epidermal growth factor receptors, including EGFR (ErbB-1), Her2/neu (ErbB-2), Her3 (ErbB-3), Her4 (ErbB-4), may benefit from pI engineered constant region(s) of the invention. For example the pI engineered constant region(s) of the invention may find use in an antibody that is substantially similar to trastuzumab (Herceptin®, Genentech) (see for example U.S. Pat. No. 5,677,171), a humanized anti-Her2/neu antibody approved to treat breast cancer; pertuzumab (rhuMab-2C4, Omnitarg™) currently being developed by Genentech; an anti-Her2 antibody described in U.S. Pat. No. 4,753,894; cetuximab (Erbitux®, Imclone) (U.S. Pat. No. 4,943,533; PCT WO 96/40210), a chimeric anti-EGFR antibody in clinical trials for a variety of cancers; ABX-EGF (U.S. Pat. No. 6,235,883), currently being developed by Abgenix-Immunex-Amgen; HuMax-EGFr (U.S. Ser. No. 10/172, 317), currently being developed by Genmab; 425, EMD55900, EMD62000, and EMD72000 (Merck KGaA) (U.S. Pat. No. 5,558,864; Murthy et al. 1987, Arch Biochem Biophys. 252(2):549-60; Rodeck et al., 1987, J Cell Biochem. 35(4):315-20; Kettleborough et al., 1991, Protein Eng. 4(7):773-83); ICR62 (Institute of Cancer Research) (PCT WO 95/20045; Modjtahedi et al., 1993, J. Cell Biophys. 1993, 22(1-3):129-46; Modjtahedi et al., 1993, Br J Cancer. 1993, 67(2):247-53; Modjtahedi et al, 1996, Br J Cancer, 73(2):228-35; Modjtahedi et al, 2003, Int J Cancer, 105(2):273-80); TheraClM hR3 (YM Biosciences, Canada and Centro de Immunologia Molecular, Cuba (U.S. Pat. Nos. 5,891,996; 6,506,883; Mateo et al, 1997, Immunotechnology, 3(1):71-81); mAb-806 (Ludwig Institue for Cancer Research, Memorial Sloan-Kettering) (Jungbluth et al. 2003, Proc Natl Acad Sci USA. 100(2):639-44); KSB-102 (KS Biomedix); MR1-1 (IVAX, National Cancer Institute) (PCT WO 0162931A2); and SC100 (Scancell) (PCT WO 01/88138). In another preferred embodiment, the pI engineered constant region(s) of the present invention may find use in alemtuzumab (Campath®, Millenium), a humanized monoclonal antibody currently approved for treatment of B-cell chronic lymphocytic leukemia. The pI engineered constant region(s) of the present invention may find use in a variety of antibodies that are substantially similar to other clinical products and candidates, including but not limited to muromonab-CD3 (Orthoclone OKT3®), an anti-CD3 antibody developed by Ortho Biotech/Johnson & Johnson, ibritumomab tiuxetan (Zevalin®), an anti-CD20 antibody developed by IDEC/Schering AG, gemtuzumab ozogamicin (Mylotarg®), an anti-CD33 (p67 protein) antibody developed by Celltech/Wyeth, alefacept (Amevive®), an anti-LFA-3 Fc fusion developed by Biogen), abciximab (ReoPro®), developed by Centocor/Lilly, basiliximab (Simulect®), developed by Novartis, palivizumab (Synagis®), developed by MedImmune, infliximab (Remicade®), an anti-TNFalpha antibody developed by Centocor, adalimumab (Humira®), an anti-TNFalpha antibody developed by Abbott, Humicade™, an anti-TNFalpha antibody developed by Celltech, etanercept (Enbrel®), an anti-TNFalpha Fc fusion developed by Immunex/Amgen, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, 90Y-muHMFG1), an anti-MUC1 In development by Antisoma, Therex (R1550), an anti-MUC1 antibody being developed by Antisoma, AngioMab (AS1405), being developed by Antisoma, HuBC-1, being developed by Antisoma, Thioplatin (AS1407) being developed by Antisoma, Antegren® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF-β2 antibody being developed by Cambridge Antibody Technology, J695, an anti-IL-12 antibody being developed by Cambridge Antibody Technology and Abbott, CAT-192, an anti-TGFβ1 antibody being developed by Cambridge Antibody Technology and Genzyme, CAT-213, an anti-Eotaxinl antibody being developed by Cambridge Antibody Technology, LymphoStat-B™ an anti-Blys antibody being developed by Cambridge Antibody Technology and Human Genome Sciences Inc., TRAIL-RlmAb, an anti-TRAIL-R1 antibody being developed by Cambridge Antibody Technology and Human Genome Sciences, Inc., Avastin™ (bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair™ (Omalizumab), an anti-IgE antibody being developed by Genentech, Raptiva™ (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-flk-1 antibody being developed by Imclone, anti-VE cadherin antibodies being developed by Imclone, CEA-Cide™ (labetuzumab), an anti-carcinoembryonic antigen (CEA) antibody being developed by Immunomedics, LymphoCide™ (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem™ (IDM-1), and anti-Her2 antibody being developed by Medarex and Immuno-Designed Molecules, HuMax™-CD4, an anti-CD4 antibody being developed by Medarex and Genmab, HuMax-IL15, an anti-IL15 antibody being developed by Medarex and Genmab, CNTO 148, an anti-TNFα antibody being developed by Medarex and Centocor/J&J, CNTO 1275, an anti-cytokine antibody being developed by Centocor/J&J, MOR101 and MOR102, anti-intercellular adhesion molecule-1 (ICAM-1) (CD54) antibodies being developed by Morph® Sys, MOR201, an anti-fibroblast growth factor receptor 3 (FGFR-3) antibody being developed by MorphoSys, Nuvion® (visilizumab), an anti-CD3 antibody being developed by Protein Design Labs, HuZAF™, an anti-gamma interferon antibody being developed by Protein Design Labs, Anti-a5131 Integrin, being developed by Protein Design Labs, anti-IL-12, being developed by Protein Design Labs, ING-1, an anti-Ep-CAM antibody being developed by Xoma, and MLN01, an anti-Beta2 integrin antibody being developed by Xoma, an pI-ADC antibody being developed by Seattle Genetics, all of the above-cited references in this paragraph are expressly incorporated herein by reference.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities.

"Specific binding" or "specifically binds to" or is "specific for" a particular antigen or an epitope means binding that is measurably different from a nonspecific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about 10-4 M, at least about 10-5 M, at least about 10-6 M, at least about 10-7 M, at least about 10-8 M, at least about 10-9 M, alternatively at least about 10-10 M, at least about 10-11 M, at least about 10-12 M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

Antibody-Drug Conjugates

In some embodiments, the multispecific antibodies of the invention are conjugated with drugs to form antibody-drug conjugates (ADCs). In general, ADCs are used in oncology applications, where the use of antibody-drug conjugates for the local delivery of cytotoxic or cytostatic agents allows for the targeted delivery of the drug moiety to tumors, which can allow higher efficacy, lower toxicity, etc. An overview of this technology is provided in Ducry et al., Bioconjugate Chem., 21:5-13 (2010), Carter et al., Cancer J. 14(3):154 (2008) and Senter, Current Opin. Chem. Biol. 13:235-244 (2009), all of which are hereby incorporated by reference in their entirety.

Thus the invention provides multispecific antibodies conjugated to drugs. Generally, conjugation is done by covalent attachment to the antibody, as further described below, and generally relies on a linker, often a peptide linkage (which, as described below, may be designed to be sensitive to cleavage by proteases at the target site or not). In addition, as described above, linkage of the linker-drug unit (LU-D) can be done by attachment to cysteines within the antibody. As will be appreciated by those in the art, the number of drug moieties per antibody can change, depending on the conditions of the reaction, and can vary from 1:1 to 10:1 drug: antibody. As will be appreciated by those in the art, the actual number is an average.

Thus the invention provides multispecific antibodies conjugated to drugs. As described below, the drug of the ADC can be any number of agents, including but not limited to cytotoxic agents such as chemotherapeutic agents, growth inhibitory agents, toxins (for example, an enzymatically active toxin of bacterial, fungal, plant, or animal origin, or fragments thereof), or a radioactive isotope (that is, a radioconjugate) are provided. In other embodiments, the invention further provides methods of using the ADCs.

Drugs for use in the present invention include cytotoxic drugs, particularly those which are used for cancer therapy. Such drugs include, in general, DNA damaging agents, anti-metabolites, natural products and their analogs. Exemplary classes of cytotoxic agents include the enzyme inhibitors such as dihydrofolate reductase inhibitors, and thymidylate synthase inhibitors, DNA intercalators, DNA cleavers, topoisomerase inhibitors, the anthracycline family of drugs, the *vinca* drugs, the mitomycins, the bleomycins, the cytotoxic nucleosides, the pteridine family of drugs, diynenes, the podophyllotoxins, dolastatins, maytansinoids, differentiation inducers, and taxols.

Members of these classes include, for example, methotrexate, methopterin, dichloromethotrexate, 5-fluorouracil, 6-mercaptopurine, cytosine arabinoside, melphalan, leurosine, leurosideine, actinomycin, daunorubicin, doxorubicin, mitomycin C, mitomycin A, caminomycin, aminopterin, tallysomycin, podophyllotoxin and podophyllotoxin derivatives such as etoposide or etoposide phosphate, vinblastine, vincristine, vindesine, taxanes including taxol, taxotere retinoic acid, butyric acid, N8-acetyl spermidine, camptothecin, calicheamicin, esperamicin, ene-diynes, duocarmycin A, duocarmycin SA, calicheamicin, camptothecin, maytansinoids (including DM1), monomethylauristatin E (MMAE), monomethylauristatin F (MMAF), and maytansinoids (DM4) and their analogues.

Toxins may be used as antibody-toxin conjugates and include bacterial toxins such as diphtheria toxin, plant toxins such as ricin, small molecule toxins such as geldanamycin (Mandler et al (2000) J. Nat. Cancer Inst. 92(19):1573-1581; Mandler et al (2000) Bioorganic & Med. Chem. Letters 10:1025-1028; Mandler et al (2002) Bioconjugate Chem. 13:786-791), maytansinoids (EP 1391213; Liu et al., (1996) Proc. Natl. Acad. Sci. USA 93:8618-8623), and calicheamicin (Lode et al (1998) Cancer Res. 58:2928; Hinman et al (1993) Cancer Res. 53:3336-3342). Toxins may exert their cytotoxic and cytostatic effects by mechanisms including tubulin binding, DNA binding, or topoisomerase inhibition.

Conjugates of a multispecific antibody and one or more small molecule toxins, such as a maytansinoids, dolastatins, auristatins, a trichothecene, calicheamicin, and CC1065, and the derivatives of these toxins that have toxin activity, are contemplated.

Maytansinoids

Maytansine compounds suitable for use as maytansinoid drug moieties are well known in the art, and can be isolated from natural sources according to known methods, produced using genetic engineering techniques (see Yu et al (2002) PNAS 99:7968-7973), or maytansinol and maytansinol analogues prepared synthetically according to known methods. As described below, drugs may be modified by the incorporation of a functionally active group such as a thiol or amine group for conjugation to the antibody.

Exemplary maytansinoid drug moieties include those having a modified aromatic ring, such as: C-19-dechloro (U.S. Pat. No. 4,256,746) (prepared by lithium aluminum hydride reduction of ansamytocin P2); C-20-hydroxy (or C-20-demethyl)+/−C-19-dechloro (U.S. Pat. Nos. 4,361,650 and 4,307,016) (prepared by demethylation using *Streptomyces* or *Actinomyces* or dechlorination using LAH); and C-20-demethoxy, C-20-acyloxy (—OCOR), +/−dechloro (U.S. Pat. No. 4,294,757) (prepared by acylation using acyl chlorides) and those having modifications at other positions Exemplary maytansinoid drug moieties also include those having modifications such as: C-9-SH (U.S. Pat. No. 4,424,219) (prepared by the reaction of maytansinol with H2S or P2S5); C-14-alkoxymethyl(demethoxy/CH2OR) (U.S. Pat. No. 4,331,598); C-14-hydroxymethyl or acyloxymethyl (CH2OH or CH2OAc) (U.S. Pat. No. 4,450,254) (prepared from *Nocardia*); C-15-hydroxy/acyloxy (U.S. Pat. No. 4,364,866) (prepared by the conversion of maytansinol by *Streptomyces*); C-15-methoxy (U.S. Pat. Nos. 4,313,946 and 4,315,929) (isolated from Trewia nudlflora); C-18-N-demethyl (U.S. Pat. Nos. 4,362,663 and 4,322,348) (prepared by the demethylation of maytansinol by *Streptomyces*); and 4,5-deoxy (U.S. Pat. No. 4,371,533) (prepared by the titanium trichloride/LAH reduction of maytansinol).

Of particular use are DM1 (disclosed in U.S. Pat. No. 5,208,020, incorporated by reference) and DM4 (disclosed in U.S. Pat. No. 7,276,497, incorporated by reference). See also a number of additional maytansinoid derivatives and methods in U.S. Pat. No. 5,416,064, WO/01/24763, U.S. Pat. Nos. 7,303,749, 7,601,354, U.S. Ser. No. 12/631,508, WO02/098883, U.S. Pat. Nos. 6,441,163, 7,368,565, WO02/16368 and WO04/1033272, all of which are expressly incorporated by reference in their entirety.

ADCs containing maytansinoids, methods of making same, and their therapeutic use are disclosed, for example, in U.S. Pat. Nos. 5,208,020; 5,416,064; 6,441,163 and European Patent EP 0 425 235 B1, the disclosures of which are hereby expressly incorporated by reference. Liu et al., Proc. Natl. Acad. Sci. USA 93:8618-8623 (1996) described ADCs comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Chari et al., Cancer Research 52:127-131 (1992) describe ADCs in which a maytansinoid was conjugated via a disulfide linker to the murine antibody A7 binding to an antigen on human colon cancer cell lines, or to another murine monoclonal antibody TA.1 that binds the HER-2/neu oncogene. The cytotoxicity of the TA.1-maytansonoid conjugate was tested in vitro on the human breast cancer cell line SK-BR-3, which expresses $3 \times 10^5$ HER-2 surface antigens per cell. The drug conjugate achieved a degree of cytotoxicity similar to the free maytansinoid drug, which could be increased by increasing the number of maytansinoid molecules per antibody molecule. The A7-maytansinoid conjugate showed low systemic cytotoxicity in mice.

Auristatins and Dolastatins

In some embodiments, the ADC comprises a multispecific antibody conjugated to dolastatins or dolostatin peptidic analogs and derivatives, the auristatins (U.S. Pat. Nos. 5,635,483; 5,780,588). Dolastatins and auristatins have been shown to interfere with microtubule dynamics, GTP hydrolysis, and nuclear and cellular division (Woyke et al (2001) Antimicrob. Agents and Chemother. 45(12):3580-3584) and have anticancer (U.S. Pat. No. 5,663,149) and antifungal activity (Pettit et al (1998) Antimicrob. Agents Chemother. 42:2961-2965). The dolastatin or auristatin drug moiety may be attached to the antibody through the N (amino) terminus or the C (carboxyl) terminus of the peptidic drug moiety (WO 02/088172).

Exemplary auristatin embodiments include the N-terminus linked monomethylauristatin drug moieties DE and DF, disclosed in "Senter et al, Proceedings of the American Association for Cancer Research, Volume 45, Abstract Number 623, presented Mar. 28, 2004 and described in United States Patent Publication No. 2005/0238648, the disclosure of which is expressly incorporated by reference in its entirety.

An exemplary auristatin embodiment is MMAE (see U.S. Pat. No. 6,884,869 expressly incorporated by reference in its entirety).

Another exemplary auristatin embodiment is MMAF (see US 2005/0238649, U.S. Pat. Nos. 5,767,237 and 6,124,431, expressly incorporated by reference in their entirety).

Additional exemplary embodiments comprising MMAE or MMAF and various linker components (described further herein) have the following structures and abbreviations (wherein Ab means antibody and p is 1 to about 8):

Typically, peptide-based drug moieties can be prepared by forming a peptide bond between two or more amino acids and/or peptide fragments. Such peptide bonds can be prepared, for example, according to the liquid phase synthesis method (see E. Schroder and K. Lubke, "The Peptides", volume 1, pp 76-136, 1965, Academic Press) that is well known in the field of peptide chemistry. The auristatin/dolastatin drug moieties may be prepared according to the methods of: U.S. Pat. Nos. 5,635,483; 5,780,588; Pettit et al (1989) J. Am. Chem. Soc. 111:5463-5465; Pettit et al (1998) Anti-Cancer Drug Design 13:243-277; Pettit, G. R., et al. Synthesis, 1996, 719-725; Pettit et al (1996) J. Chem. Soc. Perkin Trans. 1 5:859-863; and Doronina (2003) Nat Biotechnol 21(7):778-784.

Calicheamicin

In other embodiments, the ADC comprises an antibody of the invention conjugated to one or more calicheamicin molecules. For example, Mylotarg is the first commercial ADC drug and utilizes calicheamicin yl as the payload (see U.S. Pat. No. 4,970,198, incorporated by reference in its entirety). Additional calicheamicin derivatives are described in U.S. Pat. Nos. 5,264,586, 5,384,412, 5,550,246, 5,739,116, 5,773,001, 5,767,285 and 5,877,296, all expressly incorporated by reference. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, $\gamma 1I$, $\alpha 2I$, $\alpha 2I$, N-acetyl-$\gamma I1$, PSAG and $\theta I1$ (Hinman et al., Cancer Research 53:3336-3342 (1993), Lode et al., Cancer Research 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Duocarmycins

CC-1065 (see U.S. Pat. No. 4,169,888, incorporated by reference) and duocarmycins are members of a family of antitumor antibiotics utilized in ADCs. These antibiotics appear to work through sequence-selectively alkylating DNA at the N3 of adenine in the minor groove, which initiates a cascade of events that result in apoptosis.

Important members of the duocarmycins include duocarmycin A (U.S. Pat. No. 4,923,990, incorporated by reference) and duocarmycin SA (U.S. Pat. No. 5,101,038, incorporated by reference), and a large number of analogues as described in U.S. Pat. Nos. 7,517,903, 7,691,962, 5,101,038; 5,641,780; 5,187,186; 5,070,092; 5,070,092; 5,641,780; 5,101,038; 5,084,468, 5,475,092, 5,585,499, 5,846,545, WO2007/089149, WO2009/017394A1, U.S. Pat. Nos. 5,703,080, 6,989,452, 7,087,600, 7,129,261, 7,498,302, and 7,507,420, all of which are expressly incorporated by reference.

Other Cytotoxic Agents

Other antitumor agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232 published Oct. 28, 1993.

The present invention further contemplates an ADC formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated antibodies. Examples include At211, I131, I125, Y90, Re186, Re188, Sm153, Bi212, P32, Pb212 and radioactive isotopes of Lu.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as Tc99m or I123, Re186, Re188 and In111 can be attached via a cysteine residue in the peptide. Yttrium-90 can be attached via a lysine residue. The IODOGEN method (Fraker et al (1978) Biochem. Biophys. Res. Commun. 80: 49-57 can be used to incorporate Iodine-123. "Monoclonal Antibodies in Immunoscintigraphy" (Chatal, CRC Press 1989) describes other methods in detail.

For compositions comprising a plurality of antibodies, the drug loading is represented by p, the average number of drug molecules per Antibody. Drug loading may range from 1 to 20 drugs (D) per Antibody. The average number of drugs per antibody in preparation of conjugation reactions may be characterized by conventional means such as mass spectroscopy, ELISA assay, and HPLC. The quantitative distribution of Antibody-Drug-Conjugates in terms of p may also be determined.

In some instances, separation, purification, and characterization of homogeneous Antibody-Drug-conjugates where p is a certain value from Antibody-Drug-Conjugates with other drug loadings may be achieved by means such as reverse phase HPLC or electrophoresis. In exemplary embodiments, p is 2, 3, 4, 5, 6, 7, or 8 or a fraction thereof.

The generation of Antibody-drug conjugate compounds can be accomplished by any technique known to the skilled artisan. Briefly, the Antibody-drug conjugate compounds can include a multispecific antibody as the Antibody unit, a drug, and optionally a linker that joins the drug and the binding agent.

A number of different reactions are available for covalent attachment of drugs and/or linkers to binding agents. This is can be accomplished by reaction of the amino acid residues of the binding agent, for example, antibody molecule, including the amine groups of lysine, the free carboxylic acid groups of glutamic and aspartic acid, the sulfhydryl groups of cysteine and the various moieties of the aromatic amino acids. A commonly used nonspecific methods of covalent attachment is the carbodiimide reaction to link a carboxy (or amino) group of a compound to amino (or carboxy) groups of the antibody. Additionally, bifunctional agents such as dialdehydes or imidoesters have been used to link the amino group of a compound to amino groups of an antibody molecule.

Also available for attachment of drugs to binding agents is the Schiff base reaction. This method involves the periodate oxidation of a drug that contains glycol or hydroxy groups, thus forming an aldehyde which is then reacted with the binding agent. Attachment occurs via formation of a Schiff base with amino groups of the binding agent. Isothiocyanates can also be used as coupling agents for covalently attaching drugs to binding agents. Other techniques are known to the skilled artisan and within the scope of the present invention.

In some embodiments, an intermediate, which is the precursor of the linker, is reacted with the drug under appropriate conditions. In other embodiments, reactive groups are used on the drug and/or the intermediate. The product of the reaction between the drug and the intermediate, or the derivatized drug, is subsequently reacted with an multispecific antibody of the invention under appropriate conditions.

It will be understood that chemical modifications may also be made to the desired compound in order to make reactions of that compound more convenient for purposes of preparing conjugates of the invention. For example a functional group e.g. amine, hydroxyl, or sulfhydryl, may be appended to the drug at a position which has minimal or an acceptable effect on the activity or other properties of the drug Linker Units Typically, the antibody-drug conjugate compounds comprise a Linker unit between the drug unit and the antibody unit. In some embodiments, the linker is cleavable under intracellular or extracellular conditions, such that cleavage of the linker releases the drug unit from the antibody in the appropriate environment. For example, solid tumors that secrete certain proteases may serve as the target of the cleavable linker; in other embodiments, it is the intracellular proteases that are utilized. In yet other embodiments, the linker unit is not cleavable and the drug is released, for example, by antibody degradation in lysosomes.

In some embodiments, the linker is cleavable by a cleaving agent that is present in the intracellular environment (for example, within a lysosome or endosome or caveolea). The linker can be, for example, a peptidyl linker that is cleaved by an intracellular peptidase or protease enzyme, including, but not limited to, a lysosomal or endosomal protease. In some embodiments, the peptidyl linker is at least two amino acids long or at least three amino acids long or more.

Cleaving agents can include, without limitation, cathepsins B and D and plasmin, all of which are known to hydrolyze dipeptide drug derivatives resulting in the release of active drug inside target cells (see, e.g., Dubowchik and Walker, 1999, Pharm. Therapeutics 83:67-123). Peptidyl linkers that are cleavable by enzymes that are present in CD38-expressing cells. For example, a peptidyl linker that is cleavable by the thiol-dependent protease cathepsin-B, which is highly expressed in cancerous tissue, can be used (e.g., a Phe-Leu or a Gly-Phe-Leu-Gly linker (SEQ ID NO: 730)). Other examples of such linkers are described, e.g., in U.S. Pat. No. 6,214,345, incorporated herein by reference in its entirety and for all purposes.

In some embodiments, the peptidyl linker cleavable by an intracellular protease is a Val-Cit linker or a Phe-Lys linker (see, e.g., U.S. Pat. No. 6,214,345, which describes the synthesis of doxorubicin with the val-cit linker).

In other embodiments, the cleavable linker is pH-sensitive, that is, sensitive to hydrolysis at certain pH values. Typically, the pH-sensitive linker hydrolyzable under acidic conditions. For example, an acid-labile linker that is hydrolyzable in the lysosome (for example, a hydrazone, semicarbazone, thiosemicarbazone, cis-aconitic amide, orthoester, acetal, ketal, or the like) may be used. (See, e.g., U.S. Pat. Nos. 5,122,368; 5,824,805; 5,622,929; Dubowchik and Walker, 1999, Pharm. Therapeutics 83:67-123; Neville et al., 1989, Biol. Chem. 264:14653-14661.) Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929).

In yet other embodiments, the linker is cleavable under reducing conditions (for example, a disulfide linker). A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio) toluene)-, SPDB and SMPT. (See, e.g., Thorpe et al., 1987, Cancer Res. 47:5924-5931; Wawrzynczak et al., In Immunoconjugates: Antibody Conjugates in Radioimagery and Therapy of Cancer (C. W. Vogel ed., Oxford U. Press, 1987. See also U.S. Pat. No. 4,880,935.)

In other embodiments, the linker is a malonate linker (Johnson et al., 1995, Anticancer Res. 15:1387-93), a maleimidobenzoyl linker (Lau et al., 1995, Bioorg-Med-Chem. 3(10):1299-1304), or a 3'-N-amide analog (Lau et al., 1995, Bioorg-Med-Chem. 3(10):1305-12).

In yet other embodiments, the linker unit is not cleavable and the drug is released by antibody degradation. (See U.S. Publication No. 2005/0238649 incorporated by reference herein in its entirety and for all purposes).

In many embodiments, the linker is self-immolative. As used herein, the term "self-immolative Spacer" refers to a bifunctional chemical moiety that is capable of covalently linking together two spaced chemical moieties into a stable tripartite molecule. It will spontaneously separate from the second chemical moiety if its bond to the first moiety is cleaved. See for example, WO 2007059404A2, WO06/110476A2, WO05112919A2, WO2010/062171, WO09/017394, WO07/089149, WO 07/018431, WO04/043493 and WO02/083180, which are directed to drug-cleavable substrate conjugates where the drug and cleavable substrate are optionally linked through a self-immolative linker and which are all expressly incorporated by reference.

Often the linker is not substantially sensitive to the extracellular environment. As used herein, "not substantially sensitive to the extracellular environment," in the context of a linker, means that no more than about 20%, 15%, 10%, 5%, 3%, or no more than about 1% of the linkers, in a sample of antibody-drug conjugate compound, are cleaved when the antibody-drug conjugate compound presents in an extracellular environment (for example, in plasma).

Whether a linker is not substantially sensitive to the extracellular environment can be determined, for example, by incubating with plasma the antibody-drug conjugate compound for a predetermined time period (for example, 2, 4, 8, 16, or 24 hours) and then quantitating the amount of free drug present in the plasma.

In other, non-mutually exclusive embodiments, the linker promotes cellular internalization. In certain embodiments, the linker promotes cellular internalization when conjugated to the therapeutic agent (that is, in the milieu of the linker-therapeutic agent moiety of the antibody-drug conjugate compound as described herein). In yet other embodiments, the linker promotes cellular internalization when conjugated to both the auristatin compound and the multispecific antibodies of the invention.

A variety of exemplary linkers that can be used with the present compositions and methods are described in WO 2004-010957, U.S. Publication No. 2006/0074008, U.S. Publication No. 20050238649, and U.S. Publication No. 2006/0024317 (each of which is incorporated by reference herein in its entirety and for all purposes).

Drug Loading

Drug loading is represented by p and is the average number of Drug moieties per antibody in a molecule. Drug loading ("p") may be 1, 2, 3, 4, 5, 6, 7, 8, 9, 10, 11, 12, 13, 14, 15, 16, 17, 18, 19, 20 or more moieties (D) per antibody, although frequently the average number is a fraction or a decimal. Generally, drug loading of from 1 to 4 is frequently useful, and from 1 to 2 is also useful. ADCs of the invention include collections of antibodies conjugated with a range of drug moieties, from 1 to 20. The average number of drug moieties per antibody in preparations of ADC from conjugation reactions may be characterized by conventional means such as mass spectroscopy and, ELISA assay.

The quantitative distribution of ADC in terms of p may also be determined. In some instances, separation, purification, and characterization of homogeneous ADC where p is a certain value from ADC with other drug loadings may be achieved by means such as electrophoresis.

For some antibody-drug conjugates, p may be limited by the number of attachment sites on the antibody. For example, where the attachment is a cysteine thiol, as in the exemplary embodiments above, an antibody may have only one or several cysteine thiol groups, or may have only one or several sufficiently reactive thiol groups through which a linker may be attached. In certain embodiments, higher drug loading, e.g. p>5, may cause aggregation, insolubility, toxicity, or loss of cellular permeability of certain antibody-drug conjugates. In certain embodiments, the drug loading for an ADC of the invention ranges from 1 to about 8; from about 2 to about 6; from about 3 to about 5; from about 3 to about 4; from about 3.1 to about 3.9; from about 3.2 to about 3.8; from about 3.2 to about 3.7; from about 3.2 to about 3.6; from about 3.3 to about 3.8; or from about 3.3 to about 3.7. Indeed, it has been shown that for certain ADCs, the optimal ratio of drug moieties per antibody may be less than 8, and may be about 2 to about 5. See US 2005-0238649 A1 (herein incorporated by reference in its entirety).

In certain embodiments, fewer than the theoretical maximum of drug moieties are conjugated to an antibody during a conjugation reaction. An antibody may contain, for example, lysine residues that do not react with the drug-linker intermediate or linker reagent, as discussed below. Generally, antibodies do not contain many free and reactive cysteine thiol groups which may be linked to a drug moiety; indeed most cysteine thiol residues in antibodies exist as disulfide bridges. In certain embodiments, an antibody may be reduced with a reducing agent such as dithiothreitol (DTT) or tricarbonylethylphosphine (TCEP), under partial or total reducing conditions, to generate reactive cysteine thiol groups. In certain embodiments, an antibody is subjected to denaturing conditions to reveal reactive nucleophilic groups such as lysine or cysteine.

The loading (drug/antibody ratio) of an ADC may be controlled in different ways, e.g., by: (i) limiting the molar excess of drug-linker intermediate or linker reagent relative to antibody, (ii) limiting the conjugation reaction time or temperature, (iii) partial or limiting reductive conditions for cysteine thiol modification, (iv) engineering by recombinant techniques the amino acid sequence of the antibody such that the number and position of cysteine residues is modified for control of the number and/or position of linker-drug attachements (such as thioMab or thioFab prepared as disclosed herein and in WO2006/034488 (herein incorporated by reference in its entirety)).

It is to be understood that where more than one nucleophilic group reacts with a drug-linker intermediate or linker reagent followed by drug moiety reagent, then the resulting product is a mixture of ADC compounds with a distribution of one or more drug moieties attached to an antibody. The average number of drugs per antibody may be calculated from the mixture by a dual ELISA antibody assay, which is specific for antibody and specific for the drug. Individual ADC molecules may be identified in the mixture by mass spectroscopy and separated by HPLC, e.g. hydrophobic interaction chromatography.

In some embodiments, a homogeneous ADC with a single loading value may be isolated from the conjugation mixture by electrophoresis or chromatography.

Methods of Determining Cytotoxic Effect of ADCs

Methods of determining whether a Drug or Antibody-Drug conjugate exerts a cytostatic and/or cytotoxic effect on a cell are known. Generally, the cytotoxic or cytostatic activity of an Antibody Drug conjugate can be measured by: exposing mammalian cells expressing a target protein of the Antibody Drug conjugate in a cell culture medium; culturing the cells for a period from about 6 hours to about 5 days; and measuring cell viability. Cell-based in vitro assays can be used to measure viability (proliferation), cytotoxicity, and induction of apoptosis (caspase activation) of the Antibody Drug conjugate.

For determining whether an Antibody Drug conjugate exerts a cytostatic effect, a thymidine incorporation assay may be used. For example, cancer cells expressing a target antigen at a density of 5,000 cells/well of a 96-well plated can be cultured for a 72-hour period and exposed to 0.5 µCi of 3H-thymidine during the final 8 hours of the 72-hour period. The incorporation of 3H-thymidine into cells of the culture is measured in the presence and absence of the Antibody Drug conjugate.

For determining cytotoxicity, necrosis or apoptosis (programmed cell death) can be measured. Necrosis is typically accompanied by increased permeability of the plasma membrane; swelling of the cell, and rupture of the plasma membrane. Apoptosis is typically characterized by membrane blebbing, condensation of cytoplasm, and the activation of endogenous endonucleases. Determination of any of these effects on cancer cells indicates that an Antibody Drug conjugate is useful in the treatment of cancers.

Cell viability can be measured by determining in a cell the uptake of a dye such as neutral red, trypan blue, or ALAMAR™ blue (see, e.g., Page et al., 1993, Intl. J. Oncology 3:473-476). In such an assay, the cells are incubated in media containing the dye, the cells are washed, and the remaining dye, reflecting cellular uptake of the dye, is measured spectrophotometrically. The protein-binding dye sulforhodamine B (SRB) can also be used to measure cytoxicity (Skehan et al., 1990, J. Natl. Cancer Inst. 82:1107-12).

Alternatively, a tetrazolium salt, such as MTT, is used in a quantitative colorimetric assay for mammalian cell survival and proliferation by detecting living, but not dead, cells (see, e.g., Mosmann, 1983, J. Immunol. Methods 65:55-63).

Apoptosis can be quantitated by measuring, for example, DNA fragmentation. Commercial photometric methods for the quantitative in vitro determination of DNA fragmentation are available. Examples of such assays, including TUNEL (which detects incorporation of labeled nucleotides in fragmented DNA) and ELISA-based assays, are described in Biochemica, 1999, no. 2, pp. 34-37 (Roche Molecular Biochemicals).

Apoptosis can also be determined by measuring morphological changes in a cell. For example, as with necrosis, loss of plasma membrane integrity can be determined by measuring uptake of certain dyes (e.g., a fluorescent dye such as, for example, acridine orange or ethidium bromide). A method for measuring apoptotic cell number has been described by Duke and Cohen, Current Protocols in Immunology (Coligan et al. eds., 1992, pp. 3.17.1-3.17.16). Cells also can be labeled with a DNA dye (e.g., acridine orange, ethidium bromide, or propidium iodide) and the cells observed for chromatin condensation and margination along the inner nuclear membrane. Other morphological changes that can be measured to determine apoptosis include, e.g., cytoplasmic condensation, increased membrane blebbing, and cellular shrinkage.

The presence of apoptotic cells can be measured in both the attached and "floating" compartments of the cultures. For example, both compartments can be collected by removing the supernatant, trypsinizing the attached cells, combining the preparations following a centrifugation wash step (e.g., 10 minutes at 2000 rpm), and detecting apoptosis (e.g., by measuring DNA fragmentation). (See, e.g., Piazza et al., 1995, Cancer Research 55:3110-16).

In vivo, the effect of a therapeutic composition of the multispecific antibody of the invention can be evaluated in a suitable animal model. For example, xenogenic cancer models can be used, wherein cancer explants or passaged xenograft tissues are introduced into immune compromised animals, such as nude or SCID mice (Klein et al., 1997, Nature Medicine 3: 402-408). Efficacy can be measured using assays that measure inhibition of tumor formation, tumor regression or metastasis, and the like.

Therapeutic Uses of Heterodimers

The multispecific proteins, particularly the multispecific antibodies of the present invention find use in a variety of therapeutic uses. As discussed in FIG. 1 of Kontermann, supra, incorporated herein by reference, there are a number of dual targeting strategies for cancer, inflammation, etc.

Pharmaceutical Formulations, Administration and Dosing

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16th Edition, A. Osal., Ed., 1980).

Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to provide antibodies with other specifcities. Alternatively, or in addition, the composition may comprise a cytotoxic agent, cytokine, growth inhibitory agent and/or small molecule antagonist. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration should be sterile, or nearly so. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and .gamma. ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Administrative Modalities

The antibodies and chemotherapeutic agents of the invention are administered to a subject, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody is preferred.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Thus for B cell tumors, the subject may experience a decrease in the so-called B symptoms, i.e., night sweats, fever, weight loss, and/or urticaria. For pre-malignant conditions, therapy with an multispecific therapeutic agent may block and/or prolong the time before development of a related malignant condition, for example, development of multiple myeloma in subjects suffering from monoclonal gammopathy of undetermined significance (MGUS).

An improvement in the disease may be characterized as a complete response. By "complete response" is intended an absence of clinically detectable disease with normalization of any previously abnormal radiographic studies, bone marrow, and cerebrospinal fluid (CSF) or abnormal monoclonal protein in the case of myeloma.

Such a response may persist for at least 4 to 8 weeks, or sometimes 6 to 8 weeks, following treatment according to the methods of the invention. Alternatively, an improvement in the disease may be categorized as being a partial response. By "partial response" is intended at least about a 50% decrease in all measurable tumor burden (i.e., the number of malignant cells present in the subject, or the measured bulk of tumor masses or the quantity of abnormal monoclonal protein) in the absence of new lesions, which may persist for 4 to 8 weeks, or 6 to 8 weeks.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the multispecific antibodies used in the present invention depend on the disease or condition to be treated and may be determined by the persons skilled in the art.

An exemplary, non-limiting range for a therapeutically effective amount of an multispecific antibody used in the present invention is about 0.1-100 mg/kg, such as about 0.1-50 mg/kg, for example about 0.1-20 mg/kg, such as about 0.1-10 mg/kg, for instance about 0.5, about such as 0.3, about 1, or about 3 mg/kg. In another embodiment, he antibody is administered in a dose of 1 mg/kg or more, such as a dose of from 1 to 20 mg/kg, e.g. a dose of from 5 to 20 mg/kg, e.g. a dose of 8 mg/kg.

A medical professional having ordinary skill in the art may readily determine and prescribe the effective amount of the pharmaceutical composition required. For example, a physician or a veterinarian could start doses of the medicament employed in the pharmaceutical composition at levels lower than that required in order to achieve the desired therapeutic effect and gradually increase the dosage until the desired effect is achieved.

In one embodiment, the multispecific antibody is administered by infusion in a weekly dosage of from 10 to 500 mg/kg such as of from 200 to 400 mg/kg Such administration may be repeated, e.g., 1 to 8 times, such as 3 to 5 times. The administration may be performed by continuous infusion over a period of from 2 to 24 hours, such as of from 2 to 12 hours.

In one embodiment, the multispecific antibody is administered by slow continuous infusion over a long period, such as more than 24 hours, if required to reduce side effects including toxicity.

In one embodiment the multispecific antibody is administered in a weekly dosage of from 250 mg to 2000 mg, such as for example 300 mg, 500 mg, 700 mg, 1000 mg, 1500 mg or 2000 mg, for up to 8 times, such as from 4 to 6 times. The administration may be performed by continuous infusion over a period of from 2 to 24 hours, such as of from 2 to 12 hours. Such regimen may be repeated one or more times as necessary, for example, after 6 months or 12 months. The dosage may be determined or adjusted by measuring the amount of compound of the present invention in the blood upon administration by for instance taking out a biological sample and using anti-idiotypic antibodies which target the antigen binding region of the multispecific antibody.

In a further embodiment, the multispecific antibody is administered once weekly for 2 to 12 weeks, such as for 3 to 10 weeks, such as for 4 to 8 weeks.

In one embodiment, the multispecific antibody is administered by maintenance therapy, such as, e.g., once a week for a period of 6 months or more.

In one embodiment, the multispecific antibody is administered by a regimen including one infusion of an multispecific antibody followed by an infusion of an multispecific antibody conjugated to a radioisotope. The regimen may be repeated, e.g., 7 to 9 days later.

As non-limiting examples, treatment according to the present invention may be provided as a daily dosage of an antibody in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

In some embodiments the multispecific antibody molecule thereof is used in combination with one or more additional therapeutic agents, e.g. a chemotherapeutic agent. Non-limiting examples of DNA damaging chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea).

Chemotherapeutic agents that disrupt cell replication include: paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinase; antibodies which bind to proteins overexpressed in cancers and thereby downregulate cell replication (e.g., trastuzumab, rituximab, cetuximab, and bevacizumab); and other inhibitors of proteins or enzymes known to be upregulated, over-expressed or activated in cancers, the inhibition of which downregulates cell replication.

In some embodiments, the antibodies of the invention can be used prior to, concurrent with, or after treatment with Velcade® (bortezomib).

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Example 1 scFv Production

DNA encoding the anti-CD3 scFv with a C-terminal GlySer linker and His6-tag was generated by gene synthesis (Blue Heron Biotechnology, Bothell, Wash.) and was subcloned using standard molecular biology techniques into the expression vector pTT5. Substitutions were introduced using either site-directed mutagenesis (QuikChange, Stratagene, Cedar Creek, Tex.) or additional gene synthesis and subcloning using a BspEI restriction site placed in the (Gly4Ser)3 VH-VL linker. DNA was transfected into HEK293E cells for expression and resulting proteins were purified from the supernatant using nickel affinity (Qiagen, Valencia, Calif.) chromatography.

Determination of Tm

Differential scanning fluorimetry (DSF) experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 sec. Melting temperatures were calculated using the instrument software. The results are shown in FIG. 3A-3B.

Binding Studies: Human

Competition binding protocol: Binding of scFvs to CD3 was measured on T cells in a competition experiment with labeled anti-CD3 antibody. Proteins at various concentrations were incubated on ice for 1 h with 400 k PBMCs and PE-labeled anti-CD3 antibody (final concentration of 2 µg/ml). FITC-labeled anti-CD4 (BD Biosciences, San Diego, Calif.) and APC-labeled anti-CD8 (BioLegend, San Diego, Calif.) antibodies were added and incubated for an additional 30 min in 3% FBS/PBS. Samples were washed twice, fixed with 1% paraformaldehyde/PBS and analyzed using a FACSCanto II flow cytometer (BD Biosciences). T cells were identified as CD4+ or CD8+ live lymphocytes; approximately 4,000-10,000 events were captured per sample. Binding of PE-labeled anti-CD3 antibody to T cells was quantified by mean fluorescence intensity (MFI) values of CD4+ live lymphocytes, which were then plotted against the log of the scFv concentrations. Data was fitted with a sigmoidal dose-response curve using Prism 6 (GraphPad Software) and the relative affinities were determined as $IC_{50}$ values of each curve. Percentage fold improvements were calculated from the H1 L1.4 scFv. Results are shown in FIG. 4A-4B.

Binding Studies: Monkey

Binding of Fabs to CD3 was measured on cynomolgus monkey (specifically *Macaca fascicularis*) T cells in a competition experiment with labeled anti-CD3 antibody. Proteins at various concentrations were incubated on ice for 1.5 h with 200 k PBMCs and FITC-labeled anti-CD3 antibody (final concentration of 50 ng/mL). APC-labeled anti-CD4 (BD Biosciences, San Diego, Calif.) antibody was added and incubated for an additional 1 hr in 3% FBS/PBS. Samples were washed twice, fixed with 1% paraformaldehyde/PBS and analyzed using a FACSCanto II flow cytometer (BD Biosciences). T cells were identified as CD4+ live lymphocytes; approximately 2,000-3,000 events were captured per sample. Binding of FITC-labeled anti-CD3 antibody to T cells was quantified by mean fluorescence intensity (MFI) values of CD4+ live lymphocytes, which were then plotted against the log of the Fab concentrations. Data was fitted with a sigmoidal dose-response curve using Prism 6 (GraphPad Software) and the relative affinities were determined as $IC_{50}$ values of each curve.

Example 2

Design of charged scFv linkers to enable IEX purification of scFv containing heterodimeric bispecific antibodies.

We have previously engineered the antibody constant regions of heterodimeric antibodies to have higher or lower pI using both isotypic and isosteric charge substitutions. These methods enable efficient IEX purification of heterodimeric species, but may impact stability or immunogenicity of the antibodies due to the unnatural substitutions introduced. For scFv containing heterodimeric bispecific antibodies (Examples are shown in FIG. 46), another region to introduce charged substitutions is the scFv linker that connects the VH and VL of scFv constructs. The most common linker used is (GGGGS)3 or (GGGGS)4, which has been shown to be flexible enough to allow stable scFv formation without diabody formation. These sequences are already unnatural, and contain little sequence specificity for likely immunogenic epitopes. Therefore we thought that introducing charged substitutions into scFv linkers may be a good strategy to enable IEX purification of heterodimeric bispecific species containing scFvs. Various positively and negatively charged scFv linkers were designed and are shown in FIG. 20. All linkers are novel constructs except for the "Whitlow" linker which was reported by Whitlow et al., (Whitlow M, Protein Eng. 1993 (8), 989-995). Linkers designated as 6paxA_1 (+A) and 3hsc_2 (−A) were taken from a database of unstructured regions in human proteins obtained from PDB files and these linkers are approximately the same length as (GGGGS)3 and contain positive or negative charges. Other linkers are based on introducing repetitive Lys or Glu residues, as well as Lys-Pro motifs designed to reduce the chance of proteolytic degradation in the positively charged linkers.

Charged linkers were first evaluated for biophysical behavior in the scFv-His format and then were later constructed in anti-CD19×CD3 Fab-scFv-Fc bispecific format. Genes encoding the scFv of engineered forms of the anti-CD3 antibody SP34 or the anti-CD19 4G7 antibody were constructed in the mammalian expression vector pTT5. For full-length constructs, the human IgG1 constant chain gene was obtained from IMAGE clones and subcloned into the pTT5 vector. scFv genes were synthesized commercially (Blue Heron Biotechnologies, Bothell Wash. Amino acid modifications were constructed using site-directed mutagenesis using the QuikChange® site-directed mutagenesis methods (Stratagene, La Jolla Calif.). All DNA was sequenced to confirm the fidelity of the sequences.

Plasmids containing scFv or heavy chain and light chain genes were transfected (or co-transfected for full-length formats) into 293E cells using lipofectamine (Invitrogen, Carlsbad Calif.) and grown in FreeStyle 293 media (Invitrogen, Carlsbad Calif.). After 5 days of growth, the antibodies were purified from the culture supernatant by protein A (full-length) using the MabSelect resin (GE Healthcare) or using Ni-NTA resing for His-tagged scFvs. Heterodimers were further purified by ion exchange chromatograpy (IEX) to assess the ability of the altered pI heavy chains to enable efficient purification. Examples of IEX purifications for an anti-CD19×CD3 bispecific containing a positively charged linker in the CD3 scFv is shown in FIG. 7A-7U. Antibody concentrations were determined by bicinchoninic acid (BCA) assay (Pierce).

The pI engineered scFvs or antibodies were characterized by SDS-PAGE, size exclusion chromatography (SEC), iso-electric focusing (IEF) gel electrophoresis, and/or differential scanning fluorimetry (DSF).

Example 3

Stability and Behavior of scFvs Containing Charged Linkers.

Anti-CD3 scFv's and anti-CD19 scFv's containing positively or negatively charged linkers, respectively, were evaluated for SEC behavior as well as for stability using DSF. Differential scanning fluorimetry (DSF) was used to evaluate the stability of scFvs containing charged linkers. DSF experiments were performed using a Bio-Rad CFX Connect Real-Time PCR Detection System. Proteins were mixed with SYPRO Orange fluorescent dye and diluted to 0.25 or 0.50 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 sec. Melting temperatures were calculated using the instrument software. Tm values for scFvs are shown in the Figure. Charged linkers had only marginal impacts on overall scFv stability as indicated by their Tm values. SEC chromatograms obtained from purified scFvs are shown in the Figures. Highly charged linkers have a longer elution time and noticeable peak tails indicating that too much charge causes the scFvs to stick to the SEC resin longer than expected. Binding results for positively charged anti-CD3 scFvs binding to CD4+ T cells (Figure) indicated that binding of most scFvs was similar, with the exception of the very highly charged (GKGKS)4 scFv, which showed weaker binding. No off-target binding was detected when gating for CD20+ cells in PBMCs. However, when off-target binding was tested using SP34 cells, some amount of off-target binding was seen with the highest charged linkers at high concentrations (Figure).

Positively charged scFv linkers on the anti-CD3 scFv in an anti-CD19×CD3 Fab-scFv-Fc construct had the unexpected property of reducing the amount of high molecular weight aggregation (Figure). SEC chromatograms of two bispecific constructs (13121—with standard (GGGGS)4 linker) and (13124—with charged linker (GKPGS)4) incubated at various concentrations confirmed this phenomenon.

Activity of anti-CD19×CD3 constructs containing charged scFv linkers in the anti-CD3 scFv was evaluated using an RTCC assay with PBMCs and Fab-scFv-Fc format bispecific anti-CD19×CD3 antibodies containing different scFv linkers (Figure). Linkers have little impact on RTCC activity, except for the highly charged linker (GKGKS)3 which has lower activity.

Sequences for all constructs of the invention are shown in FIG. 53A-53O.

SEQUENCE LISTING (730 sequences)

SEQ ID NO: 1 - protein, 125 aa, Artificial Sequence
  Humanized anti-CD3 heavy chain variable region
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 2 - protein, 109 aa, Artificial Sequence
  Humanized anti-CD3 light chain variable region
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 3 - protein, 257 aa, Artificial Sequence
  XENP11502 H1_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 4 - protein, 249 aa, Artificial Sequence
  XENP11502 H1_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 5 - protein, 125 aa, Artificial Sequence; identical to SEQ ID NO: 1
  XENP11502 H1_L1.4

SEQ ID NO: 6 - protein, 109 aa, Artificial Sequence; identical to SEQ ID NO: 2
  XENP11502 H1_L1.4

SEQ ID NO: 7 - protein, 257 aa, Artificial Sequence
  XENP11794 H1.3_L1.4
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 8 - protein, 249 aa, Artificial Sequence
  XENP11794 H1.3_L1.4
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 9 - protein, 125 aa, Artificial Sequence
  XENP11794 H1.3_L1.4
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 10 - protein, 109 aa, Artificial Sequence; identical to SEQ ID NO: 2
  XENP11794 H1.3_L1.4

SEQ ID NO: 11 - protein, 257 aa, Artificial Sequence
  XENP11795 H1.4_L1.4
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 12 - protein, 249 aa, Artificial Sequence
  XENP11795 H1.4_L1.4
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 13 - protein, 125 aa, Artificial Sequence
  XENP11795 H1.4_L1.4
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 14 - protein, 109 aa, Artificial Sequence; identical to SEQ ID NO: 2
  XENP11795 H1.4_L1.4

SEQ ID NO: 15 - protein, 257 aa, Artificial Sequence
  XENP11796 H1.5_L1.4
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 16 - protein, 249 aa, Artificial Sequence
  XENP11796 H1.5_L1.4
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 17 - protein, 125 aa, Artificial Sequence
  XENP11796 H1.5_L1.4
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 18 - protein, 109 aa, Artificial Sequence; identical to SEQ ID NO: 2
  XENP11796 H1.5_L1.4

SEQ ID NO: 19 - protein, 257 aa, Artificial Sequence
  XENP11801 H1.6_L1.4
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 20 - protein, 249 aa, Artificial Sequence
  XENP11801 H1.6_L1.4
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 21 - protein, 125 aa, Artificial Sequence
  XENP11801 H1.6_L1.4
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 22 - protein, 109 aa, Artificial Sequence; identical to SEQ ID NO: 2
  XENP11801 H1.6_L1.4

SEQ ID NO: 23 - protein, 257 aa, Artificial Sequence
  XENP11802 H1.7_L1.4
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 24 - protein, 249 aa, Artificial Sequence
  XENP11802 H1.7_L1.4
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 25 - protein, 125 aa, Artificial Sequence
  XENP11802 H1.7_L1.4
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 26 - protein, 109 aa, Artificial Sequence; identical to SEQ ID NO: 2
  XENP11802 H1.7_L1.4

SEQ ID NO: 27 - protein, 257 aa, Artificial Sequence
  XENP11803 H1.8_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 28 - protein, 249 aa, Artificial Sequence
  XENP11803 H1.8_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 29 - protein, 125 aa, Artificial Sequence
  XENP11803 H1.8_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 30 - protein, 109 aa, Artificial Sequence; identical to SEQ ID NO: 2
  XENP11803 H1.8_L1.4

SEQ ID NO: 31 - protein, 257 aa, Artificial Sequence
  XENP11804 H1.9_L1.4
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 32 - protein, 249 aa, Artificial Sequence
  XENP11804 H1.9_L1.4
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 33 - protein, 125 aa, Artificial Sequence
  XENP11804 H1.9_L1.4
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 34 - protein, 109 aa, Artificial Sequence; identical to SEQ ID NO: 2
  XENP11804 H1.9_L1.4

SEQ ID NO: 35 - protein, 257 aa, Artificial Sequence
  XENP11805 H1.10_L1.4
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 36 - protein, 249 aa, Artificial Sequence
  XENP11805 H1.10_L1.4
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 37 - protein, 125 aa, Artificial Sequence
  XENP11805 H1.10_L1.4
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 38 - protein, 109 aa, Artificial Sequence; identical to SEQ ID NO: 2
  XENP11805 H1.10_L1.4

SEQ ID NO: 39 - protein, 256 aa, Artificial Sequence
  XENP11806 H1.11_L1.4
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHH

SEQ ID NO: 40 - protein, 249 aa, Artificial Sequence
  XENP11806 H1.11_L1.4
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 41 - protein, 125 aa, Artificial Sequence
  XENP11806 H1.11_L1.4
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 42 - protein, 109 aa, Artificial Sequence; identical to SEQ ID NO: 2
  XENP11806 H1.11_L1.4

SEQ ID NO: 43 - protein, 257 aa, Artificial Sequence
  XENP11807 H1.12_L1.4
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 44 - protein, 249 aa, Artificial Sequence
  XENP11807 H1.12_L1.4
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 45 - protein, 125 aa, Artificial Sequence
  XENP11807 H1.12_L1.4
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSS

SEQ ID NO: 46 - protein, 109 aa, Artificial Sequence; identical to SEQ ID NO: 2
  XENP11807 H1.12_L1.4

SEQ ID NO: 47 - protein, 257 aa, Artificial Sequence
  XENP11808 H1.13_L1.4
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 48 - protein, 249 aa, Artificial Sequence
  XENP11808 H1.13_L1.4
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 49 - protein, 125 aa, Artificial Sequence
  XENP11808 H1.13_L1.4
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSS

SEQ ID NO: 50 - protein, 109 aa, Artificial Sequence; identical to SEQ ID NO: 2
  XENP11808 H1.13_L1.4

SEQ ID NO: 51 - protein, 257 aa, Artificial Sequence
  XENP11809 H1.14_L1
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 52 - protein, 249 aa, Artificial Sequence
  XENP11809 H1.14_L1.4
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 53 - protein, 125 aa, Artificial Sequence
  XENP11809 H1.14_L1.4
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSS

SEQ ID NO: 54 - protein, 109 aa, Artificial Sequence; identical to SEQ ID NO: 2
  XENP11809 H1.14_L1.4

SEQ ID NO: 55 - protein, 257 aa, Artificial Sequence
  XENP11810 H1.15_L1.4
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 56 - protein, 249 aa, Artificial Sequence
  XENP11810 H1.15_L1.4
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 57 - protein, 125 aa, Artificial Sequence
  XENP11810 H1.15_L1.4
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSS

SEQ ID NO: 58 - protein, 109 aa, Artificial Sequence; identical to SEQ ID NO: 2
  XENP11810 H1.15_L1.4

SEQ ID NO: 59 - protein, 257 aa, Artificial Sequence
  XENP11811 H1.16_L1.4
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 60 - protein, 249 aa, Artificial Sequence
  XENP11811 H1.16_L1.4
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 61 - protein, 125 aa, Artificial Sequence
  XENP11811 H1.16_L1.4
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSS

SEQ ID NO: 62 - protein, 109 aa, Artificial Sequence; identical to SEQ ID NO: 2
  XENP11811 H1.16_L1.4

SEQ ID NO: 63 - protein, 257 aa, Artificial Sequence
  XENP11812 H1.17_L1.4
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 64 - protein, 249 aa, Artificial Sequence
  XENP11812 H1.17_L1.4
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 65 - protein, 109 aa, Artificial Sequence; identical to SEQ ID NO: 2
  XENP11812 H1.17_L1.4

SEQ ID NO: 66 - protein, 109 aa, Artificial Sequence; identical to SEQ ID NO: 2
  XENP11812 H1.17_L1.4

SEQ ID NO: 67 - protein, 257 aa, Artificial Sequence
  XENP11813 H1.18_L1.4
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 68 - protein, 249 aa, Artificial Sequence
  XENP11813 H1.18_L1.4
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 69 - protein, 125 aa, Artificial Sequence
  XENP11813 H1.18_L1.4
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSS

SEQ ID NO: 70 - protein, 109 aa, Artificial Sequence; identical to SEQ ID NO: 2
  XENP11813 H1.18_L1.4

SEQ ID NO: 71 - protein, 257 aa, Artificial Sequence
  XENP11814 H1.19_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 72 - protein, 249 aa, Artificial Sequence
  XENP11814 H1.19_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 73 - protein, 125 aa, Artificial Sequence
  XENP11814 H1.19_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSS

SEQ ID NO: 74 - protein, 109 aa, Artificial Sequence; identical to SEQ ID NO: 2
  XENP11814 H1.19_L1.4

SEQ ID NO: 75 - protein, 257 aa, Artificial Sequence
  XENP11815 H1.20_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 76 - protein, 249 aa, Artificial Sequence
  XENP11815 H1.20_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 77 - protein, 125 aa, Artificial Sequence
  XENP11815 H1.20_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSS

SEQ ID NO: 78 - protein, 109 aa, Artificial Sequence; identical to SEQ ID NO: 2
  XENP11815 H1.20_L1.4

SEQ ID NO: 79 - protein, 257 aa, Artificial Sequence
  XENP11816 H1.21_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 80 - protein, 249 aa, Artificial Sequence
  XENP11816 H1.21_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 81 - protein, 125 aa, Artificial Sequence
  XENP11816 H1.21_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSS

SEQ ID NO: 82 - protein, 109 aa, Artificial Sequence; identical to SEQ ID NO: 2
  XENP11816 H1.21_L1.4

SEQ ID NO: 83 - protein, 257 aa, Artificial Sequence
  XENP11817 H1.22_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 84 - protein, 249 aa, Artificial Sequence
  XENP11817 H1.22_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 85 - protein, 125 aa, Artificial Sequence
  XENP11817 H1.22_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSS

SEQ ID NO: 86 - protein, 109 aa, Artificial Sequence; identical to SEQ ID NO: 2
  XENP11817 H1.22_L1.4

SEQ ID NO: 87 - protein, 257 aa, Artificial Sequence
  XENP11818 H1.23_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 88 - protein, 249 aa, Artificial Sequence
  XENP11818 H1.23_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 89 - protein, 125 aa, Artificial Sequence
  XENP11818 H1.23_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSS

SEQ ID NO: 90 - protein, 109 aa, Artificial Sequence; identical to SEQ ID NO: 2
  XENP11818 H1.23_L1.4

SEQ ID NO: 91 - protein, 257 aa, Artificial Sequence
  XENP11819 H1.24_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 92 - protein, 249 aa, Artificial Sequence
  XENP11819 H1.24_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 93 - protein, 125 aa, Artificial Sequence
  XENP11819 H1.24_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 94 - protein, 109 aa, Artificial Sequence; identical to SEQ ID NO: 2
  XENP11819 H1.24_L1.4

SEQ ID NO: 95 - protein, 257 aa, Artificial Sequence
  XENP11820 H1.25_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 96 - protein, 249 aa, Artificial Sequence
  XENP11820 H1.25_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 97 - protein, 125 aa, Artificial Sequence
  XENP11820 H1.25_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSS

SEQ ID NO: 98 - protein, 109 aa, Artificial Sequence; identical to SEQ ID NO: 2
  XENP11820 H1.25_L1.4

SEQ ID NO: 99 - protein, 257 aa, Artificial Sequence
  XENP11821 H1.26_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 100 - protein, 249 aa, Artificial Sequence
  XENP11821 H1.26_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 101 - protein, 125 aa, Artificial Sequence
  XENP11821 H1.26_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSS

SEQ ID NO: 102 - protein, 109 aa, Artificial Sequence; identical to SEQ ID NO: 2
  XENP11821 H1.26_L1.4

SEQ ID NO: 103 - protein, 257 aa, Artificial Sequence
  XENP11822 H1.27_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 104 - protein, 249 aa, Artificial Sequence
  XENP11822 H1.27_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 105 - protein, 125 aa, Artificial Sequence
  XENP11822 H1.27_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSS

SEQ ID NO: 106 - protein, 109 aa, Artificial Sequence; identical to SEQ ID NO: 2
  XENP11822 H1.27_L1.4

SEQ ID NO: 107 - protein, 257 aa, Artificial Sequence
  XENP11823 H1.28_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 108 - protein, 249 aa, Artificial Sequence
  XENP11823 H1.28_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 109 - protein, 125 aa, Artificial Sequence
  XENP11823 H1.28_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSS

SEQ ID NO: 110 - protein, 109 aa, Artificial Sequence; identical to SEQ ID NO: 2
  XENP11823 H1.28_L1.4

SEQ ID NO: 111 - protein, 257 aa, Artificial Sequence
  XENP11824 H1.29_L1.30
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 112 - protein, 249 aa, Artificial Sequence
  XENP11824 H1.29_L1.30
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 113 - protein, 125 aa, Artificial Sequence
  XENP11824 H1.29_L1.30
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSS

SEQ ID NO: 114 - protein, 109 aa, Artificial Sequence; identical to SEQ ID NO: 2
  XENP11824 H1.29_L1.30

SEQ ID NO: 115 - protein, 257 aa, Artificial Sequence
  XENP11825 H1_L1.10
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 116 - protein, 249 aa, Artificial Sequence
  XENP11825 H1_L1.10
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 117 - protein, 125 aa, Artificial Sequence; identical to SEQ ID NO: 1
  XENP11825 H1_L1.10

SEQ ID NO: 118 - protein, 109 aa, Artificial Sequence
  XENP11825 H1_L1.10
QAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 119 - protein, 257 aa, Artificial Sequence
  XENP11826 H1_L1.11
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 120 - protein, 249 aa, Artificial Sequence
  XENP11826 H1_L1.11
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 121 - protein, 125 aa, Artificial Sequence; identical to SEQ ID NO: 1
  XENP11826 H1_L1.11

SEQ ID NO: 122 - protein, 109 aa, Artificial Sequence
  XENP11826 H1_L1.11
QAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 123 - protein, 257 aa, Artificial Sequence
  XENP11827 H1_L1.12
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 124 - protein, 249 aa, Artificial Sequence
  XENP11827 H1_L1.12
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 125 - protein, 125 aa, Artificial Sequence; identical to SEQ ID NO: 1
  XENP11827 H1_L1.12

SEQ ID NO: 126 - protein, 109 aa, Artificial Sequence
  XENP11827 H1_L1.12
QAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 127 - protein, 257 aa, Artificial Sequence
  XENP11828 H1_L1.13
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 128 - protein, 249 aa, Artificial Sequence
  XENP11828 H1_L1.13
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 129 - protein, 125 aa, Artificial Sequence; identical to SEQ ID NO: 1
  XENP11828 H1_L1.13

SEQ ID NO: 130 - protein, 109 aa, Artificial Sequence
  XENP11828 H1_L1.13
QAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 131 - protein, 257 aa, Artificial Sequence
  XENP11829 H1_L1.14
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 132 - protein, 249 aa, Artificial Sequence
  XENP11829 H1_L1.14
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 133 - protein, 125 aa, Artificial Sequence; identical to SEQ ID NO: 1
  XENP11829 H1_L1.14

SEQ ID NO: 134 - protein, 109 aa, Artificial Sequence
  XENP11829 H1_L1.14
QAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 135 - protein, 257 aa, Artificial Sequence
  XENP11830 H1_L1.15
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 136 - protein, 249 aa, Artificial Sequence
  XENP11830 H1_L1.15
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 137 - protein, 125 aa, Artificial Sequence; identical to SEQ ID NO: 1
  XENP11830 H1_L1.15

SEQ ID NO: 138 - protein, 109 aa, Artificial Sequence
  XENP11830 H1_L1.15
QAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 139 - protein, 257 aa, Artificial Sequence
  XENP11831 H1_L1.16
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVLGSHHHHHH

SEQ ID NO: 140 - protein, 248 aa, Artificial Sequence
  XENP11831 H1_L1.16
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTV

SEQ ID NO: 141 - protein, 125 aa, Artificial Sequence; identical to SEQ ID NO: 1
  XENP11831 H1_L1.16

SEQ ID NO: 142 - protein, 109 aa, Artificial Sequence
  XENP11831 H1_L1.16
QAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVL

SEQ ID NO: 143 - protein, 257 aa, Artificial Sequence
  XENP11832 H1_L1.17
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVLGSHHHHHH

SEQ ID NO: 144 - protein, 249 aa, Artificial Sequence
  XENP11832 H1_L1.17
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 145 - protein, 125 aa, Artificial Sequence; identical to SEQ ID NO: 1
  XENP11832 H1_L1.17

SEQ ID NO: 146 - protein, 109 aa, Artificial Sequence
  XENP11832 H1_L1.17
QAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 147 - protein, 257 aa, Artificial Sequence
  XENP11833 H1_L1.18
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVLGSHHHHHH

SEQ ID NO: 148 - protein, 249 aa, Artificial Sequence
  XENP11833 H1_L1.18
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 149 - protein, 125 aa, Artificial Sequence; identical to SEQ ID NO: 1
  XENP11833 H1_L1.18

SEQ ID NO: 150 - protein, 109 aa, Artificial Sequence
  XENP11833 H1_L1.18
QAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 151 - protein, 257 aa, Artificial Sequence
  XENP11834 H1_L1.19
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVLGSHHHHHH

SEQ ID NO: 152 - protein, 249 aa, Artificial Sequence
  XENP11834 H1_L1.19
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 153 - protein, 125 aa, Artificial Sequence; identical to SEQ ID NO: 1
  XENP11834 H1_L1.19

SEQ ID NO: 154 - protein, 109 aa, Artificial Sequence
  XENP11834 H1_L1.19
QAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 155 - protein, 257 aa, Artificial Sequence
  XENP11835 H1_L1.20
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVLGSHHHHHH

SEQ ID NO: 156 - protein, 249 aa, Artificial Sequence
  XENP11835 H1_L1.20
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 157 - protein, 125 aa, Artificial Sequence; identical to SEQ ID NO: 1
  XENP11835 H1_L1.20

SEQ ID NO: 158 - protein, 109 aa, Artificial Sequence
  XENP11835 H1_L1.20
QAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 159 - protein, 257 aa, Artificial Sequence
  XENP11836 H1_L1.21
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVLGSHHHHHH

SEQ ID NO: 160 - protein, 249 aa, Artificial Sequence
  XENP11836 H1_L1.21
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 161 - protein, 125 aa, Artificial Sequence; identical to SEQ ID NO: 1
  XENP11836 H1_L1.21

SEQ ID NO: 162 - protein, 109 aa, Artificial Sequence
  XENP11836 H1_L1.21
QAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 163 - protein, 257 aa, Artificial Sequence
  XENP11837 H1_L1.22
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVLGSHHHHHH

SEQ ID NO: 164 - protein, 249 aa, Artificial Sequence
  XENP11837 H1_L1.22
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 165 - protein, 125 aa, Artificial Sequence; identical to SEQ ID NO: 1
  XENP11837 H1_L1.22

SEQ ID NO: 166 - protein, 109 aa, Artificial Sequence
  XENP11837 H1_L1.22
QAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 167 - protein, 257 aa, Artificial Sequence
  XENP11838 H1_L1.23
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVLGSHHHHHH

SEQ ID NO: 168 - protein, 249 aa, Artificial Sequence
  XENP11838 H1_L1.23
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 169 - protein, 125 aa, Artificial Sequence; identical to SEQ ID NO: 1
  XENP11838 H1_L1.23

SEQ ID NO: 170 - protein, 109 aa, Artificial Sequence
  XENP11838 H1_L1.23
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 171 - protein, 257 aa, Artificial Sequence
  XENP11839 H1_L1.24
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVLGSHHHHHH

SEQ ID NO: 172 - protein, 249 aa, Artificial Sequence
  XENP11839 H1_L1.24
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 173 - protein, 125 aa, Artificial Sequence; identical to SEQ ID NO: 1
  XENP11839 H1_L1.24

SEQ ID NO: 174 - protein, 109 aa, Artificial Sequence
  XENP11839 H1_L1.24
QAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 175 - protein, 257 aa, Artificial Sequence
  XENP11840 H1_L1.25
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVLGSHHHHHH

SEQ ID NO: 176 - protein, 249 aa, Artificial Sequence
  XENP11840 H1_L1.25
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 177 - protein, 125 aa, Artificial Sequence; identical to SEQ ID NO: 1
  XENP11840 H1_L1.25

SEQ ID NO: 178 - protein, 109 aa, Artificial Sequence
  XENP11840 H1_L1.25
QAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 179 - protein, 257 aa, Artificial Sequence
  XENP11841 H1_L1.26
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVLGSHHHHHH

SEQ ID NO: 180 - protein, 249 aa, Artificial Sequence
  XENP11841 H1_L1.26
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 181 - protein, 125 aa, Artificial Sequence; identical to SEQ ID NO: 1
  XENP11841 H1_L1.26

SEQ ID NO: 182 - protein, 109 aa, Artificial Sequence
  XENP11841 H1_L1.26
QAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 183 - protein, 257 aa, Artificial Sequence
  XENP11842 H1_L1.27
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVLGSHHHHHH

SEQ ID NO: 184 - protein, 249 aa, Artificial Sequence
  XENP11842 H1_L1.27
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 185 - protein, 125 aa, Artificial Sequence; identical to SEQ ID NO: 1
  XENP11842 H1_L1.27

SEQ ID NO: 186 - protein, 109 aa, Artificial Sequence
  XENP11842 H1_L1.27
QAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 187 - protein, 257 aa, Artificial Sequence
  XENP11843 H1_L1.28
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVLGSHHHHHH

SEQ ID NO: 188 - protein, 249 aa, Artificial Sequence
  XENP11843 H1_L1.28
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 189 - protein, 125 aa, Artificial Sequence; identical to SEQ ID NO: 1
  XENP11843 H1_L1.28

SEQ ID NO: 190 - protein, 109 aa, Artificial Sequence
  XENP11843 H1_L1.28
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 191 - protein, 257 aa, Artificial Sequence
  XENP11844 H1_L1.29
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGSHHHHHH

SEQ ID NO: 192 - protein, 251 aa, Artificial Sequence
  XENP11844 H1_L1.29
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 193 - protein, 125 aa, Artificial Sequence; identical to SEQ ID NO: 1
  XENP11844 H1_L1.29

SEQ ID NO: 194 - protein, 111 aa, Artificial Sequence
  XENP11844 H1_L1.29
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 195 - protein, 258 aa, Artificial Sequence
  XENP11920 H1_L3.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSEIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGSHHHHHH

SEQ ID NO: 196 - protein, 252 aa, Artificial Sequence
  XENP11920 H1_L3.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSEIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 197 - protein, 125 aa, Artificial Sequence; identical to SEQ ID NO: 1
  XENP11920 H1_L3.1

SEQ ID NO: 198 - protein, 112 aa, Artificial Sequence
  XENP11920 H1_L3.1
EIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 199 - protein, 258 aa, Artificial Sequence
  XENP11921 H1_L5.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSDIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGSHHHHHH

SEQ ID NO: 200 - protein, 252 aa, Artificial Sequence
  XENP11921 H1_L5.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSDIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 201 - protein, 125 aa, Artificial Sequence; identical to SEQ ID NO: 1
  XENP11921 H1_L5.1

SEQ ID NO: 202 - protein, 112 aa, Artificial Sequence
  XENP11921 H1_L5.1
DIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 203 - protein, 257 aa, Artificial Sequence
  XENP11922 H1_L1.31
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVLGSHHHHHH

SEQ ID NO: 204 - protein, 249 aa, Artificial Sequence
  XENP11922 H1_L1.31
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 205 - protein, 125 aa, Artificial Sequence; identical to SEQ ID NO: 1
  XENP11922 H1_L1.31

SEQ ID NO: 206 - protein, 109 aa, Artificial Sequence
  XENP11922 H1_L1.31
QAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 207 - protein, 257 aa, Artificial Sequence
  XENP11923 H1_L1.32
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVLGSHHHHHH

SEQ ID NO: 208 - protein, 249 aa, Artificial Sequence
  XENP11923 H1_L1.32
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 209 - protein, 125 aa, Artificial Sequence; identical to SEQ ID NO: 1
  XENP11923 H1_L1.32

SEQ ID NO: 210 - protein, 109 aa, Artificial Sequence
  XENP11923 H1_L1.32
QAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 211 - protein, 257 aa, Artificial Sequence
  XENP12107 H1.38_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 212 - protein, 249 aa, Artificial Sequence
  XENP12107 H1.38_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 213 - protein, 125 aa, Artificial Sequence
  XENP12107 H1.38_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSS

SEQ ID NO: 214 - protein, 109 aa, Artificial Sequence; identical to SEQ ID NO: 2
  XENP12107 H1.38_L1.4

SEQ ID NO: 215 - protein, 257 aa, Artificial Sequence
  XENP12108 H1_L1.33
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLTVLGSHHHHHH

SEQ ID NO: 216 - protein, 249 aa, Artificial Sequence
  XENP12108 H1_L1.33
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLTVL

SEQ ID NO: 217 - protein, 125 aa, Artificial Sequence; identical to SEQ ID NO: 1
  XENP12108 H1_L1.33

SEQ ID NO: 218 - protein, 107 aa, Artificial Sequence
  XENP12108 H1_L1.33
QAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLT

SEQ ID NO: 219 - protein, 257 aa, Artificial Sequence
  XENP12109 H1_L1.34
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVLGSHHHHHH

SEQ ID NO: 220 - protein, 249 aa, Artificial Sequence
  XENP12109 H1_L1.34
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 221 - protein, 125 aa, Artificial Sequence; identical to SEQ ID NO: 1
  XENP12109 H1_L1.34

SEQ ID NO: 222 - protein, 109 aa, Artificial Sequence
  XENP12109 H1_L1.34
QAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 223 - protein, 257 aa, Artificial Sequence
  XENP12110 H1_L1.35
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVLGSHHHHHH

SEQ ID NO: 224 - protein, 249 aa, Artificial Sequence
  XENP12110 H1_L1.35
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 225 - protein, 125 aa, Artificial Sequence; identical to SEQ ID NO: 1
  XENP12110 H1_L1.35

SEQ ID NO: 226 - protein, 109 aa, Artificial Sequence
  XENP12110 H1_L1.35
QAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 227 - protein, 257 aa, Artificial Sequence
  XENP12111 H1_L1.36
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVLGSHHHHHH

SEQ ID NO: 228 - protein, 249 aa, Artificial Sequence
  XENP12111 H1_L1.36
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 229 - protein, 125 aa, Artificial Sequence; identical to SEQ ID NO: 1
  XENP12111 H1_L1.36

SEQ ID NO: 230 - protein, 109 aa, Artificial Sequence
  XENP12111 H1_L1.36
QAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 231 - protein, 257 aa, Artificial Sequence
  XENP12112 H1_L1.37
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVLGSHHHHHH

SEQ ID NO: 232 - protein, 249 aa, Artificial Sequence
  XENP12112 H1_L1.37
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 233 - protein, 125 aa, Artificial Sequence; identical to SEQ ID NO: 1
  XENP12112 H1_L1.37

SEQ ID NO: 234 - protein, 109 aa, Artificial Sequence
  XENP12112 H1_L1.37
QAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 235 - protein, 257 aa, Artificial Sequence
  XENP12113 H1_L1.38
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVLGSHHHHHH

SEQ ID NO: 236 - protein, 249 aa, Artificial Sequence
  XENP12113 H1_L1.38
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 237 - protein, 125 aa, Artificial Sequence; identical to SEQ ID NO: 1
  XENP12113 H1_L1.38

SEQ ID NO: 238 - protein, 109 aa, Artificial Sequence
  XENP12113 H1_L1.38
QAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 239 - protein, 257 aa, Artificial Sequence
  XENP12114 H1_L1.39
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVLGSHHHHHH

SEQ ID NO: 240 - protein, 249 aa, Artificial Sequence
  XENP12114 H1_L1.39
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 241 - protein, 125 aa, Artificial Sequence; identical to SEQ ID NO: 1
  XENP12114 H1_L1.39

SEQ ID NO: 242 - protein, 109 aa, Artificial Sequence
  XENP12114 H1_L1.39
QAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 243 - protein, 257 aa, Artificial Sequence
  XENP12131 H1.30_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 244 - protein, 249 aa, Artificial Sequence
  XENP12131 H1.30_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 245 - protein, 125 aa, Artificial Sequence
  XENP12131 H1.30_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 246 - protein, 109 aa, Artificial Sequence; identical to SEQ ID NO: 2
  XENP12131 H1.30_L1.4

SEQ ID NO: 247 - protein, 257 aa, Artificial Sequence
  XENP12132 H1.31_L1.4
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 248 - protein, 125 aa, Artificial Sequence
  XENP12132 H1.31_L1.4
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 249 - protein, 125 aa, Artificial Sequence; identical to SEQ ID NO: 248
  XENP12132 H1.31_L1.4

SEQ ID NO: 250 - protein, 109 aa, Artificial Sequence; identical to SEQ ID NO: 2
  XENP12132 H1.31_L1.4

SEQ ID NO: 251 - protein, 257 aa, Artificial Sequence
  XENP12133 H1.32_L1.4
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 252 - protein, 249 aa, Artificial Sequence
  XENP12133 H1.32_L1.4
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 253 - protein, 125 aa, Artificial Sequence
  XENP12133 H1.32_L1.4
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 254 - protein, 109 aa, Artificial Sequence; identical to SEQ ID NO: 2
  XENP12133 H1.32_L1.4

SEQ ID NO: 255 - protein, 257 aa, Artificial Sequence
  XENP12134 H1.33_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 256 - protein, 249 aa, Artificial Sequence
  XENP12134 H1.33_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 257 - protein, 125 aa, Artificial Sequence
  XENP12134 H1.33_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 258 - protein, 109 aa, Artificial Sequence; identical to SEQ ID NO: 2
  XENP12134 H1.33_L1.4

SEQ ID NO: 259 - protein, 257 aa, Artificial Sequence
  XENP12135 H1.34_L1.4
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 260 - protein, 249 aa, Artificial Sequence
  XENP12135 H1.34_L1.4
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 261 - protein, 125 aa, Artificial Sequence
  XENP12135 H1.34_L1.4
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSS

SEQ ID NO: 262 - protein, 109 aa, Artificial Sequence; identical to SEQ ID NO: 2
  XENP12135 H1.34_L1.4

SEQ ID NO: 263 - protein, 257 aa, Artificial Sequence
  XENP12136 H1.35_L1.4
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 264 - protein, 249 aa, Artificial Sequence
  XENP12136 H1.35_L1.4
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 265 - protein, 125 aa, Artificial Sequence
  XENP12136 H1.35_L1.4
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 266 - protein, 109 aa, Artificial Sequence; identical to SEQ ID NO: 2
  XENP12136 H1.35_L1.4

SEQ ID NO: 267 - protein, 255 aa, Artificial Sequence
  XENP12137 H1.36_L1.4
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 268 - protein, 247 aa, Artificial Sequence
  XENP12137 H1.36_L1.4
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 269 - protein, 123 aa, Artificial Sequence
  XENP12137 H1.36_L1.4
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSS

SEQ ID NO: 270 - protein, 109 aa, Artificial Sequence; identical to SEQ ID NO: 2
  XENP12137 H1.36_L1.4

SEQ ID NO: 271 - protein, 257 aa, Artificial Sequence
  XENP12138 H1.37_L1.4
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 272 - protein, 249 aa, Artificial Sequence
  XENP12138 H1.37_L1.4
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 273 - protein, 125 aa, Artificial Sequence
  XENP12138 H1.37_L1.4
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 274 - protein, 109 aa, Artificial Sequence; identical to SEQ ID NO: 2
  XENP12138 H1.37_L1.4

SEQ ID NO: 275 - protein, 257 aa, Artificial Sequence
  XENP12139 H1.37_L1.32
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVLGSHHHHHH

SEQ ID NO: 276 - protein, 249 aa, Artificial Sequence
  XENP12139 H1.37_L1.32
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 277 - protein, 125 aa, Artificial Sequence; identical to SEQ ID NO: 273
  XENP12139 H1.37_L1.32

SEQ ID NO: 278 - protein, 109 aa, Artificial Sequence; identical to SEQ ID NO: 210
  XENP12139 H1.37_L1.32

SEQ ID NO: 279 - protein, 257 aa, Artificial Sequence
  XENP12149 H1_L1.40
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 280 - protein, 249 aa, Artificial Sequence
  XENP12149 H1_L1.40
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 281 - protein, 125 aa, Artificial Sequence; identical to SEQ ID NO: 1
  XENP12149 H1_L1.40

SEQ ID NO: 282 - protein, 109 aa, Artificial Sequence
  XENP12149 H1_L1.40
QAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 283 - protein, 257 aa, Artificial Sequence
  XENP12213 H1.30_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 284 - protein, 249 aa, Artificial Sequence
  XENP12213 H1.30_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 285 - protein, 125 aa, Artificial Sequence; identical to SEQ ID NO: 245
  XENP12213 H1.30_L1.40

SEQ ID NO: 286 - protein, 109 aa, Artificial Sequence; identical to SEQ ID NO: 282
  XENP12213 H1.30_L1.40

SEQ ID NO: 287 - protein, 257 aa, Artificial Sequence
  XENP12214 H1.8_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 288 - protein, 249 aa, Artificial Sequence
  XENP12214 H1.8_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 289 - protein, 125 aa, Artificial Sequence; identical to SEQ ID NO: 29
  XENP12214 H1.8_L1.40

SEQ ID NO: 290 - protein, 109 aa, Artificial Sequence; identical to SEQ ID NO: 282
  XENP12214 H1.8_L1.40

SEQ ID NO: 291 - protein, 257 aa, Artificial Sequence
  XENP12215 H1.39_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 292 - protein, 249 aa, Artificial Sequence
  XENP12215 H1.39_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 293 - protein, 125 aa, Artificial Sequence
  XENP12215 H1.39_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 294 - protein, 109 aa, Artificial Sequence; identical to SEQ ID NO: 282
  XENP12215 H1.39_L1.40

SEQ ID NO: 295 - protein, 257 aa, Artificial Sequence
  XENP12216 H1.40_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 296 - protein, 249 aa, Artificial Sequence
  XENP12216 H1.40_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 297 - protein, 125 aa, Artificial Sequence
  XENP12216 H1.40_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 298 - protein, 109 aa, Artificial Sequence; identical to SEQ ID NO: 282
  XENP12216 H1.40_L1.40

SEQ ID NO: 299 - protein, 257 aa, Artificial Sequence
  XENP12217 H1.30_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 300 - protein, 249 aa, Artificial Sequence
  XENP12217 H1.30_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 301 - protein, 125 aa, Artificial Sequence; identical to SEQ ID NO: 245
  XENP12217 H1.30_L1.41

SEQ ID NO: 302 - protein, 109 aa, Artificial Sequence
  XENP12217 H1.30_L1.41
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 303 - protein, 257 aa, Artificial Sequence
  XENP12218 H1.8_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 304 - protein, 249 aa, Artificial Sequence
  XENP12218 H1.8_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 305 - protein, 125 aa, Artificial Sequence; identical to SEQ ID NO: 29
  XENP12218 H1.8_L1.41

SEQ ID NO: 306 - protein, 109 aa, Artificial Sequence; identical to SEQ ID NO: 302
  XENP12218 H1.8_L1.41

SEQ ID NO: 307 - protein, 257 aa, Artificial Sequence
  XENP12219 H1.39_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 308 - protein, 249 aa, Artificial Sequence
  XENP12219 H1.39_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 309 - protein, 125 aa, Artificial Sequence; identical to SEQ ID NO: 293
  XENP12219 H1.39_L1.41

SEQ ID NO: 310 - protein, 109 aa, Artificial Sequence; identical to SEQ ID NO: 302
  XENP12219 H1.39_L1.41

SEQ ID NO: 311 - protein, 257 aa, Artificial Sequence
  XENP12220 H1.40_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 312 - protein, 249 aa, Artificial Sequence
  XENP12220 H1.40_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 313 - protein, 125 aa, Artificial Sequence; identical to SEQ ID NO: 297
  XENP12220 H1.40_L1.41

SEQ ID NO: 314 - protein, 109 aa, Artificial Sequence; identical to SEQ ID NO: 302
  XENP12220 H1.40_L1.41

SEQ ID NO: 315 - protein, 257 aa, Artificial Sequence
  XENP12221 H1.30_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 316 - protein, 249 aa, Artificial Sequence
  XENP12221 H1.30_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 317 - protein, 125 aa, Artificial Sequence; identical to SEQ ID NO: 245
  XENP12221 H1.30_L1.42

SEQ ID NO: 318 - protein, 109 aa, Artificial Sequence
  XENP12221 H1.30_L1.42
QAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 319 - protein, 257 aa, Artificial Sequence
  XENP12222 H1.8_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 320 - protein, 249 aa, Artificial Sequence
  XENP12222 H1.8_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 321 - protein, 125 aa, Artificial Sequence; identical to SEQ ID NO: 29
  XENP12222 H1.8_L1.42

SEQ ID NO: 322 - protein, 109 aa, Artificial Sequence; identical to SEQ ID NO: 318
  XENP12222 H1.8_L1.42

SEQ ID NO: 323 - protein, 257 aa, Artificial Sequence
  XENP12223 H1.39_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 324 - protein, 249 aa, Artificial Sequence
  XENP12223 H1.39_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 325 - protein, 125 aa, Artificial Sequence; identical to SEQ ID NO: 293
  XENP12223 H1.39_L1.42

SEQ ID NO: 326 - protein, 109 aa, Artificial Sequence; identical to SEQ ID NO: 318
  XENP12223 H1.39_L1.42

SEQ ID NO: 327 - protein, 257 aa, Artificial Sequence
  XENP12224 H1.40_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 328 - protein, 249 aa, Artificial Sequence
  XENP12224 H1.40_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 329 - protein, 125 aa, Artificial Sequence; identical to SEQ ID NO: 297
  XENP12224 H1.40_L1.42

SEQ ID NO: 330 - protein, 109 aa, Artificial Sequence; identical to SEQ ID NO: 318
  XENP12224 H1.40_L1.42

SEQ ID NO: 331 - protein, 257 aa, Artificial Sequence
  XENP12225 H1.30_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 332 - protein, 249 aa, Artificial Sequence
  XENP12225 H1.30_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 333 - protein, 125 aa, Artificial Sequence; identical to SEQ ID NO: 245
  XENP12225 H1.30_L1.43

SEQ ID NO: 334 - protein, 109 aa, Artificial Sequence
  XENP12225 H1.30_L1.43
QAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 335 - protein, 257 aa, Artificial Sequence
  XENP12226 H1.8_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 336 - protein, 249 aa, Artificial Sequence
  XENP12226 H1.8_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 337 - protein, 125 aa, Artificial Sequence; identical to SEQ ID NO: 29
  XENP12226 H1.8_L1.43

SEQ ID NO: 338 - protein, 109 aa, Artificial Sequence; identical to SEQ ID NO: 334
  XENP12226 H1.8_L1.43

SEQ ID NO: 339 - protein, 257 aa, Artificial Sequence
  XENP12227 H1.39_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 340 - protein, 249 aa, Artificial Sequence
  XENP12227 H1.39_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 341 - protein, 125 aa, Artificial Sequence; identical to SEQ ID NO: 293
  XENP12227 H1.39_L1.43

SEQ ID NO: 342 - protein, 109 aa, Artificial Sequence; identical to SEQ ID NO: 334
  XENP12227 H1.39_L1.43

SEQ ID NO: 343 - protein, 257 aa, Artificial Sequence
  XENP12228 H1.40_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 344 - protein, 249 aa, Artificial Sequence
  XENP12228 H1.40_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 345 - protein, 125 aa, Artificial Sequence; identical to SEQ ID NO: 297
  XENP12228 H1.40_L1.43

SEQ ID NO: 346 - protein, 109 aa, Artificial Sequence; identical to SEQ ID NO: 334
  XENP12228 H1.40_L1.43

SEQ ID NO: 347 - protein, 257 aa, Artificial Sequence
  XENP12229 H1.30_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 348 - protein, 249 aa, Artificial Sequence
  XENP12229 H1.30_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 349 - protein, 125 aa, Artificial Sequence; identical to SEQ ID NO: 245
  XENP12229 H1.30_L1.44

SEQ ID NO: 350 - protein, 109 aa, Artificial Sequence
  XENP12229 H1.30_L1.44
QAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 351 - protein, 257 aa, Artificial Sequence
  XENP12230 H1.8_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 352 - protein, 249 aa, Artificial Sequence
  XENP12230 H1.8_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 353 - protein, 125 aa, Artificial Sequence; identical to SEQ ID NO: 29
  XENP12230 H1.8_L1.44

SEQ ID NO: 354 - protein, 109 aa, Artificial Sequence; identical to SEQ ID NO: 350
  XENP12230 H1.8_L1.44

SEQ ID NO: 355 - protein, 257 aa, Artificial Sequence
  XENP12231 H1.39_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 356 - protein, 249 aa, Artificial Sequence
  XENP12231 H1.39_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 357 - protein, 249 aa, Artificial Sequence; identical to SEQ ID NO: 356
  XENP12231 H1.39_L1.44

SEQ ID NO: 358 - protein, 109 aa, Artificial Sequence; identical to SEQ ID NO: 350
  XENP12231 H1.39_L1.44

SEQ ID NO: 359 - protein, 257 aa, Artificial Sequence
  XENP12232 H1.40_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 360 - protein, 249 aa, Artificial Sequence
  XENP12232 H1.40_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 361 - protein, 125 aa, Artificial Sequence; identical to SEQ ID NO: 297
  XENP12232 H1.40_L1.44

SEQ ID NO: 362 - protein, 109 aa, Artificial Sequence; identical to SEQ ID NO: 350
  XENP12232 H1.40_L1.44

SEQ ID NO: 363 - protein, 257 aa, Artificial Sequence
  XENP12233 H1.30_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 364 - protein, 249 aa, Artificial Sequence
  XENP12233 H1.30_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 365 - protein, 125 aa, Artificial Sequence; identical to SEQ ID NO: 245
  XENP12233 H1.30_L1.45

SEQ ID NO: 366 - protein, 109 aa, Artificial Sequence
  XENP12233 H1.30_L1.45
QAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 367 - protein, 257 aa, Artificial Sequence
  XENP12234 H1.8_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 368 - protein, 249 aa, Artificial Sequence
  XENP12234 H1.8_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 369 - protein, 125 aa, Artificial Sequence; identical to SEQ ID NO: 29
  XENP12234 H1.8_L1.45

SEQ ID NO: 370 - protein, 109 aa, Artificial Sequence; identical to SEQ ID NO: 366
  XENP12234 H1.8_L1.45

SEQ ID NO: 371 - protein, 257 aa, Artificial Sequence
  XENP12235 H1.39_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 372 - protein, 249 aa, Artificial Sequence
  XENP12235 H1.39_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 373 - protein, 125 aa, Artificial Sequence; identical to SEQ ID NO: 293
  XENP12235 H1.39_L1.45

SEQ ID NO: 374 - protein, 109 aa, Artificial Sequence; identical to SEQ ID NO: 366
  XENP12235 H1.39_L1.45

SEQ ID NO: 375 - protein, 257 aa, Artificial Sequence
  XENP12236 H1.40_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 376 - protein, 249 aa, Artificial Sequence
  XENP12236 H1.40_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 377 - protein, 125 aa, Artificial Sequence; identical to SEQ ID NO: 297
  XENP12236 H1.40_L1.45

SEQ ID NO: 378 - protein, 109 aa, Artificial Sequence; identical to SEQ ID NO: 366
  XENP12236 H1.40_L1.45

SEQ ID NO: 379 - protein, 257 aa, Artificial Sequence
  XENP12237 H1.30_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 380 - protein, 249 aa, Artificial Sequence
  XENP12237 H1.30_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 381 - protein, 125 aa, Artificial Sequence; identical to SEQ ID NO: 245
  XENP12237 H1.30_L1.46

SEQ ID NO: 382 - protein, 109 aa, Artificial Sequence
  XENP12237 H1.30_L1.46
QAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 383 - protein, 257 aa, Artificial Sequence
  XENP12238 H1.8_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 384 - protein, 249 aa, Artificial Sequence
  XENP12238 H1.8_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 385 - protein, 125 aa, Artificial Sequence; identical to SEQ ID NO: 29
  XENP12238 H1.8_L1.46

SEQ ID NO: 386 - protein, 109 aa, Artificial Sequence; identical to SEQ ID NO: 382
  XENP12238 H1.8_L1.46

SEQ ID NO: 387 - protein, 257 aa, Artificial Sequence
  XENP12239 H1.39_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 388 - protein, 249 aa, Artificial Sequence
  XENP12239 H1.39_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 389 - protein, 125 aa, Artificial Sequence; identical to SEQ ID NO: 293
  XENP12239 H1.39_L1.46

SEQ ID NO: 390 - protein, 109 aa, Artificial Sequence; identical to SEQ ID NO: 382
  XENP12239 H1.39_L1.46

SEQ ID NO: 391 - protein, 257 aa, Artificial Sequence
  XENP12240 H1.40_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 392 - protein, 249 aa, Artificial Sequence
  XENP12240 H1.40_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 393 - protein, 125 aa, Artificial Sequence; identical to SEQ ID NO: 297
  XENP12240 H1.40_L1.46

SEQ ID NO: 394 - protein, 109 aa, Artificial Sequence; identical to SEQ ID NO: 382
  XENP12240 H1.40_L1.46

SEQ ID NO: 395 - protein, 257 aa, Artificial Sequence
  XENP12241 H1.30_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 396 - protein, 249 aa, Artificial Sequence
  XENP12241 H1.30_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 397 - protein, 125 aa, Artificial Sequence; identical to SEQ ID NO: 245
  XENP12241 H1.30_L1.47

SEQ ID NO: 398 - protein, 109 aa, Artificial Sequence
  XENP12241 H1.30_L1.47
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 399 - protein, 257 aa, Artificial Sequence
  XENP12242 H1.8_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 400 - protein, 249 aa, Artificial Sequence
  XENP12242 H1.8_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 401 - protein, 125 aa, Artificial Sequence; identical to SEQ ID NO: 29
  XENP12242 H1.8_L1.47

SEQ ID NO: 402 - protein, 109 aa, Artificial Sequence; identical to SEQ ID NO: 398
  XENP12242 H1.8_L1.47

SEQ ID NO: 403 - protein, 257 aa, Artificial Sequence
  XENP12243 H1.39_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 404 - protein, 249 aa, Artificial Sequence
  XENP12243 H1.39_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 405 - protein, 125 aa, Artificial Sequence; identical to SEQ ID NO: 293
  XENP12243 H1.39_L1.47

SEQ ID NO: 406 - protein, 109 aa, Artificial Sequence; identical to SEQ ID NO: 398
  XENP12243 H1.39_L1.47

SEQ ID NO: 407 - protein, 257 aa, Artificial Sequence
  XENP12244 H1.40_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 408 - protein, 249 aa, Artificial Sequence
  XENP12244 H1.40_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 409 - protein, 125 aa, Artificial Sequence; identical to SEQ ID NO: 297
  XENP12244 H1.40_L1.47

SEQ ID NO: 410 - protein, 109 aa, Artificial Sequence; identical to SEQ ID NO: 398
  XENP12244 H1.40_L1.47

SEQ ID NO: 411 - protein, 5 aa, Artificial Sequence
  XENP11502 H1_L1.4/ vhCDR1
TYAMN

SEQ ID NO: 412 - protein, 5 aa, Artificial Sequence
  XENP11805/vhCDR1
TYAMS

SEQ ID NO: 413 - protein, 19 aa, Artificial Sequence
  Optimized scFv CD3 variable regions/vhCDR2
RIRSKYNNYATYYADSVKG

SEQ ID NO: 414 - protein, 19 aa, Artificial Sequence
  Optimized scFv CD3 variable regions/vhCDR2
RIRSKANNYATYYADSVKG

SEQ ID NO: 415 - protein, 17 aa, Artificial Sequence
  Optimized scFv CD3 variable regions/vhCDR2
RIRSNGGSTYYADSVKG

SEQ ID NO: 416 - protein, 14 aa, Artificial Sequence
  Optimized scFv CD3 variable regions/vhCDR3
HGNFGNSYVSWFAY

SEQ ID NO: 417 - protein, 14 aa, Artificial Sequence
  Optimized scFv CD3 variable regions/vhCDR3
HGNFGDSYVSWFAY

SEQ ID NO: 418 - protein, 14 aa, Artificial Sequence
  vhCDR3
HGNFGQSYVSWFAY

SEQ ID NO: 419 - protein, 14 aa, Artificial Sequence
  vhCDR3
HGNFGDSYVSWFDY

SEQ ID NO: 420 - protein, 14 aa, Artificial Sequence
  vlCDR1
GSSTGAVTTSNYAN

SEQ ID NO: 421 - protein, 14 aa, Artificial Sequence
  vlCDR1
GSSTGAVTSSNYAN

SEQ ID NO: 422 - protein, 14 aa, Artificial Sequence
  vlCDR1
GSSTGAVTSGHYAN

SEQ ID NO: 423 - protein, 14 aa, Artificial Sequence
  vlCDR1
RSSTGAVTTSNYAN

SEQ ID NO: 424 - protein, 14 aa, Artificial Sequence
  vlCDR1
KSSTGAVTTSNYAN

SEQ ID NO: 425 - protein, 7 aa, Artificial Sequence
  vlCDR2
GTNKRAP

SEQ ID NO: 426 - protein, 7 aa, Artificial Sequence
  vlCDR2
DTNKRAP

SEQ ID NO: 427 - protein, 7 aa, Artificial Sequence
  vlCDR2
GTNNRAP

SEQ ID NO: 428 - protein, 7 aa, Artificial Sequence
  vlCDR2
GTNKRAS

SEQ ID NO: 429 - protein, 15 aa, Artificial Sequence
  Positive charged scFv linkers
GGGGSGGGGSGGGGS

SEQ ID NO: 430 - protein, 9 aa, Artificial Sequence
  vlCDR3
ALWYSNLWV

SEQ ID NO: 431 - protein, 18 aa, Artificial Sequence
  Positive charged scFv linkers
GSTSGSGKPGSGEGSTKG

SEQ ID NO: 432 - protein, 5 aa, Artificial Sequence
  vhCDR1
TYAMH

SEQ ID NO: 433 - protein, 9 aa, Artificial Sequence
  vlCDR3
ALWYSNHWV

SEQ ID NO: 434 - protein, 19 aa, Artificial Sequence
  vhCDR2
RIRSKANSYATYYADSVKG

SEQ ID NO: 435 - protein, 5 aa, Artificial Sequence
  variable heavy chain sequence CDR1
  misc_feature (5)..(5): Xaa can be Asn, Ser or His
TYAMX

SEQ ID NO: 436 - protein, 20 aa, Artificial Sequence
  variable heavy chain sequence CDR2
  misc_feature (6)..(6): Xaa can be Tyr or Ala
  misc_feature (8)..(8): Xaa can be Asn or Ser
  misc_feature (12)..(12): Xaa can be Tyr or Ala
  misc_feature (16)..(16): Xaa can be Asp or Ala
RIRSKXNXYATXYYAXSVKG

SEQ ID NO: 437 - protein, 14 aa, Artificial Sequence
  variable heavy chain sequence CDR3
  misc_feature (6)..(6): Xaa can be Asn, Asp or Gln
  misc_feature (13)..(13): Xaa can be Ala or Asp
HGNFGXSYVSWFXY

SEQ ID NO: 438 - protein, 14 aa, Artificial Sequence
  variable light chain sequence CDR1
  misc_feature (1)..(1): Xaa can be Gly, Arg or Lys
  misc_feature (9)..(9): Xaa can be Thr or Ser
  misc_feature (10)..(10): Xaa can be Ser or Gly
  misc_feature (11)..(11): Xaa can be Asn or His
XSSTGAVTXXXYAN

SEQ ID NO: 439 - protein, 7 aa, Artificial Sequence
  variable light chain sequence CDR2
  misc_feature (1)..(1): Xaa can be Gly or Asp
  misc_feature (4)..(4): Xaa can be Lys or Asn
  misc_feature (7)..(7): Xaa can be Pro or Ser
XTNXRAX

SEQ ID NO: 440 - protein, 9 aa, Artificial Sequence
  variable light chain sequence CDR3
  misc_feature (1)..(1): Xaa can be Ala or Leu
  misc_feature (7)..(7): Xaa can be Leu or His
XLWYSNXWV

SEQ ID NO: 441 - protein, 14 aa, Artificial Sequence
  Positive charged scFv linkers
IRPRAIGGSKPRVA

SEQ ID NO: 442 - protein, 15 aa, Artificial Sequence
  Positive charged scFv linkers
GKGGSGKGGSGKGGS

SEQ ID NO: 443 - protein, 15 aa, Artificial Sequence
  Positive charged scFv linkers
GGKGSGGKGSGGKGS

SEQ ID NO: 444 - protein, 15 aa, Artificial Sequence
  Positive charged scFv linkers
GGGKSGGGKSGGGKS

SEQ ID NO: 445 - protein, 15 aa, Artificial Sequence
  Positive charged scFv linkers
GKGKSGKGKSGKGKS

SEQ ID NO: 446 - protein, 15 aa, Artificial Sequence
  Positive charged scFv linkers
GGGKSGGKGSGKGGS

SEQ ID NO: 447 - protein, 15 aa, Artificial Sequence
  Positive charged scFv linkers
GKPGSGKPGSGKPGS

SEQ ID NO: 448 - protein, 20 aa, Artificial Sequence
  Positive charged scFv linkers
GKPGSGKPGSGKPGSGKPGS

SEQ ID NO: 449 - protein, 20 aa, Artificial Sequence
  Positive charged scFv linkers
GKGKSGKGKSGKGKSGKGKS

SEQ ID NO: 450 - protein, 20 aa, Artificial Sequence
  Negative charged scFv linkers
GGGGSGGGGSGGGGSGGGGS

SEQ ID NO: 451 - protein, 14 aa, Artificial Sequence
  Negative charged scFv linkers
STAGDTHLGGEDFD

SEQ ID NO: 452 - protein, 15 aa, Artificial Sequence
  Negative charged scFv linkers
GEGGSGEGGSGEGGS

SEQ ID NO: 453 - protein, 15 aa, Artificial Sequence
  Negative charged scFv linkers
GGEGSGGEGSGGEGS

SEQ ID NO: 454 - protein, 15 aa, Artificial Sequence
  Negative charged scFv linkers
GGGESGGGESGGGES

SEQ ID NO: 455 - protein, 15 aa, Artificial Sequence
  Negative charged scFv linkers
GEGESGEGESGEGES

SEQ ID NO: 456 - protein, 15 aa, Artificial Sequence
  Negative charged scFv linkers
GGGESGGEGSGEGGS

SEQ ID NO: 457 - protein, 20 aa, Artificial Sequence
  Negative charged scFv linkers
GEGESGEGESGEGESGEGES

SEQ ID NO: 458 - protein, 256 aa, Artificial Sequence
  4G7_H1.52_L1.155_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 459 - protein, 248 aa, Artificial Sequence
  4G7_H1.52_L1.155_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 460 - protein, 256 aa, Artificial Sequence
  4G7_L1.155_H1.52_scFv_6X-His
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGSHHHHHH

SEQ ID NO: 461 - protein, 248 aa, Artificial Sequence
  4G7_L1.155_H1.52_scFv_no His
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSS

SEQ ID NO: 462 - protein, 256 aa, Artificial Sequence
  4G7_H1.211_L1.155_scFv_6X-His
EVQLVESGGGLVKPGGSLKLSCAASGYTFTSYVMHWVRQAPGKGLEWIGYINPYNDGTKYNEKFKGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 463 - protein, 248 aa, Artificial Sequence
  4G7_H1.211_L1.155_scFv_ no His
EVQLVESGGGLVKPGGSLKLSCAASGYTFTSYVMHWVRQAPGKGLEWIGYINPYNDGTKYNEKFKGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 464 - protein, 256 aa, Artificial Sequence
  4G7_H1.212_L1.155_scFv_6X-His
EVQLVESGGGLVKPGGSLKLSCAASGYTFTSYVMHWVRQAPGKGLEWIGYINPYNDGTKYNEKFQGRVTISRDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 465 - protein, 248 aa, Artificial Sequence
  4G7_H1.212_L1.155_scFv_no His
EVQLVESGGGLVKPGGSLKLSCAASGYTFTSYVMHWVRQAPGKGLEWIGYINPYNDGTKYNEKFQGRVTISRDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 466 - protein, 256 aa, Artificial Sequence
  4G7_H1.213_L1.155_scFv_6X-His
EVQLVESGGGLVKPGGSLKLSCAASGYTFTSYVMHWVRQAPGKGLEWIGYINPYNDGTKYNEKFQGRVTISSDKSKSTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 467 - protein, 248 aa, Artificial Sequence
  4G7_H1.213_L1.155_scFv_ no His
EVQLVESGGGLVKPGGSLKLSCAASGYTFTSYVMHWVRQAPGKGLEWIGYINPYNDGTKYNEKFQGRVTISSDKSKSTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 468 - protein, 256 aa, Artificial Sequence
  4G7_H1.214_L1.155_scFv_6X-His
EVQLVESGGGLVKPGGSLKLSCAASGYTFTSYVMHWVRQAPGKGLEWIGYINPYNDGTKYNEKFQGRVTISSDKSTSTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 469 - protein, 248 aa, Artificial Sequence
  4G7_H1.214_L1.155_scFv_no His
EVQLVESGGGLVKPGGSLKLSCAASGYTFTSYVMHWVRQAPGKGLEWIGYINPYNDGTKYNEKFQGRVTISSDKSTSTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 470 - protein, 256 aa, Artificial Sequence
  4G7_H1.215_L1.155_scFv_6X-His
EVQLVESGGGLVKPGGSLKLSCAASGYTFTSYVMHWVRQAPGKGLEWIGYINPYNDGTKYNEKFQGRVTISRDKSKSTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 471 - protein, 248 aa, Artificial Sequence
  4G7_H1.215_L1.155_scFv_no His
EVQLVESGGGLVKPGGSLKLSCAASGYTFTSYVMHWVRQAPGKGLEWIGYINPYNDGTKYNEKFQGRVTISRDKSKSTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 472 - protein, 256 aa, Artificial Sequence
  4G7_H1.216_L1.155_scFv_6X-His
EVQLVESGGGLVKPGGSLKLSCAASGYTFTSYVMHWVRQAPGKGLEWIGYINPYNDGTKYNEKFQGRVTISSDKSISTAYMQLSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 473 - protein, 248 aa, Artificial Sequence
  4G7_H1.216_L1.155_scFv_no His
EVQLVESGGGLVKPGGSLKLSCAASGYTFTSYVMHWVRQAPGKGLEWIGYINPYNDGTKYNEKFQGRVTISSDKSISTAYMQLSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 474 - protein, 256 aa, Artificial Sequence
  4G7_H1.217_L1.155_scFv_6X-His
EVQLVESGGGLVKPGGSLKLSCAASGYTFTSYVMHWVRQAPGKGLEWIGYINPYNDGTKYNEKFQGRVTISSDKSISTAYMKLSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 475 - protein, 248 aa, Artificial Sequence
  4G7_H1.217_L1.155_scFv no His
EVQLVESGGGLVKPGGSLKLSCAASGYTFTSYVMHWVRQAPGKGLEWIGYINPYNDGTKYNEKFQGRVTISSDKSISTAYMKLSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 476 - protein, 256 aa, Artificial Sequence
  4G7_H1.218_L1.155_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAVYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 477 - protein, 248 aa, Artificial Sequence
  4G7_H1.218_L1.155_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAVYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 478 - protein, 19 aa, Artificial Sequence
  variable heavy chain sequence CDR2
RIRSKYNNYATAYADSVKG

SEQ ID NO: 479 - protein, 19 aa, Artificial Sequence
  variable heavy chain sequence CDR2
RIRSKYNNYATYYAASVKG

SEQ ID NO: 480 - protein, 14 aa, Artificial Sequence
  variable heavy chain sequence CDR3
HGNFGNSYVSWFDY

SEQ ID NO: 481 - protein, 248 aa, Artificial Sequence
  4G7_H1.221_L1.155_scFv_no His
EVQLVESGGGLVKPGGSLKLSCAASGYTFTSYVMHWVRQAPGKGLEWIGYINPYNDGTKYNEKFQGRVTISSDKSISTAYMEMSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 482 - protein, 7 aa, Artificial Sequence
  variable heavy chain sequence CDR3
GTSNKHS

SEQ ID NO: 483 - protein, 248 aa, Artificial Sequence
  4G7_H1.222_L1.155_scFv_ no His
EVQLVESGGGLVKPGGSLKLSCAASGYTFTSYGMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 484 - protein, 256 aa, Artificial Sequence
  4G7_H1.223_L1.155_scFv_6X-His
EVQLVESGGGLVKPGGSLKLSCAASGYTFTSYVMHWVRQAPGGGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 485 - protein, 248 aa, Artificial Sequence
  4G7_H1.223_L1.155_scFv_no His
EVQLVESGGGLVKPGGSLKLSCAASGYTFTSYVMHWVRQAPGGGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 486 - protein, 256 aa, Artificial Sequence
  4G7_H1.225_L1.197_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGCGTLVTVSSGGGGSGGGGSGGGGSDIVMTQSPATLSLSPGERATLSCRSSKSLQNVNGNTYLYWFQQKPGQCPQLLIYRMSNLNSGVPDRFSGSGSGTEFTLTISSLEPEDFAVYYCMQHLEYPITFGAGTKLEIKGSHHHHHH

SEQ ID NO: 487 - protein, 248 aa, Artificial Sequence
  4G7_H1.225_L1.197_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGCGTLVTVSSGGGGSGGGGSGGGGSDIVMTQSPATLSLSPGERATLSCRSSKSLQNVNGNTYLYWFQQKPGQCPQLLIYRMSNLNSGVPDRFSGSGSGTEFTLTISSLEPEDFAVYYCMQHLEYPITFGAGTKLEIK

SEQ ID NO: 488 - protein, 256 aa, Artificial Sequence
  4G7_H1.52_L1.176_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPASLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 489 - protein, 248 aa, Artificial Sequence
  4G7_H1.52_L1.176_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPASLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 490 - protein, 256 aa, Artificial Sequence
  4G7_H1.52_L1.177_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSVSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 491 - protein, 248 aa, Artificial Sequence
  4G7_H1.52_L1.177_scFv_ no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSVSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 492 - protein, 256 aa, Artificial Sequence
  4G7_H1.52_L1.178_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATISCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 493 - protein, 248 aa, Artificial Sequence
  4G7_H1.52_L1.178_scFv_ no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATISCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 494 - protein, 256 aa, Artificial Sequence
  4G7_H1.52_L1.179_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSQSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 495 - protein, 248 aa, Artificial Sequence
  4G7_H1.52_L1.179_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSQSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 496 - protein, 256 aa, Artificial Sequence
  4G7_H1.52_L1.180_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLAWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 497 - protein, 248 aa, Artificial Sequence
  4G7_H1.52_L1.180_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLAWFQQKPGQSPQLLIYRMSNLNSGVPDRFSGSGSGTEFTLTISSLEPEDFAVYYCMQHLEYPITFGAGTKLEIK

SEQ ID NO: 498 - protein, 256 aa, Artificial Sequence
  4G7_H1.52_L1.181_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLSWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 499 - protein, 248 aa, Artificial Sequence
  4G7_H1.52_L1.181_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLSWFQQKPGQSPQLLIYRMSNLNSGVPDRFSGSGSGTEFTLTISSLEPEDFAVYYCMQHLEYPITFGAGTKLEIK

SEQ ID NO: 500 - protein, 256 aa, Artificial Sequence
  4G7_H1.52_L1.182_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLNWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 501 - protein, 248 aa, Artificial Sequence
  4G7_H1.52_L1.182_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLNWFQQKPGQSPQLLIYRMSNLNSGVPDRFSGSGSGTEFTLTISSLEPEDFAVYYCMQHLEYPITFGAGTKLEIK

SEQ ID NO: 502 - protein, 256 aa, Artificial Sequence
  4G7_H1.52_L1.183_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLDWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 503 - protein, 248 aa, Artificial Sequence
  4G7_H1.52_L1.183_scFv_ no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLDWFQQKPGQSPQLLIYRMSNLNSGVPDRFSGSGSGTEFTLTISSLEPEDFAVYYCMQHLEYPITFGAGTKLEIK

SEQ ID NO: 504 - protein, 256 aa, Artificial Sequence
  4G7_H1.52_L1.184_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWYQQKPGQSPQLLIYRMSNLNSGVPDRFSGSGSGTEFTLTISSLEPEDFAVYYCMQHLEYPITFGAGTKLEIKGSHHHHHH

SEQ ID NO: 505 - protein, 248 aa, Artificial Sequence
  4G7_H1.52_L1.184_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWYQQKPGQSPQLLIYRMSNLNSGVPDRFSGSGSGTEFTLTISSLEPEDFAVYYCMQHLEYPITFGAGTKLEIK

SEQ ID NO: 506 - protein, 256 aa, Artificial Sequence
  4G7_H1.52_L1.185_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPKLLIYRMSNLNSGVPDRFSGSGSGTEFTLTISSLEPEDFAVYYCMQHLEYPITFGAGTKLEIKGSHHHHHH

SEQ ID NO: 507 - protein, 248 aa, Artificial Sequence
  4G7_H1.52_L1.185_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPKLLIYRMSNLNSGVPDRFSGSGSGTEFTLTISSLEPEDFAVYYCMQHLEYPITFGAGTKLEIK

SEQ ID NO: 508 - protein, 256 aa, Artificial Sequence
  4G7_H1.52_L1.186_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRASNLNSGVPDRFSGSGSGTEFTLTISSLEPEDFAVYYCMQHLEYPITFGAGTKLEIKGSHHHHHH

SEQ ID NO: 509 - protein, 248 aa, Artificial Sequence
  4G7_H1.52_L1.186_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRASNLNSGVPDRFSGSGSGTEFTLTISSLEPEDFAVYYCMQHLEYPITFGAGTKLEIK

SEQ ID NO: 510 - protein, 256 aa, Artificial Sequence
  4G7_H1.52_L1.187_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLQSGVPDRFSGSGSGTEFTLTISSLEPEDFAVYYCMQHLEYPITFGAGTKLEIKGSHHHHHH

SEQ ID NO: 511 - protein, 248 aa, Artificial Sequence
  4G7_H1.52_L1.187_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLQSGVPDRFSGSGSGTEFTLTISSLEPEDFAVYYCMQHLEYPITFGAGTKLEIK

SEQ ID NO: 512 - protein, 256 aa, Artificial Sequence
  4G7_H1.52_L1.188_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLESGVPDRFSGSGSGTEFTLTISSLEPEDFAVYYCMQHLEYPITFGAGTKLEIKGSHHHHHH

SEQ ID NO: 513 - protein, 248 aa, Artificial Sequence
  4G7_H1.52_L1.188_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLESGVPDRFSGSGSGTEFTLTISSLEPEDFAVYYCMQHLEYPITFGAGTKLEIK

SEQ ID NO: 514 - protein, 256 aa, Artificial Sequence
  4G7_H1.52_L1.189_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLFSGVPDRFSGSGSGTEFTLTISSLEPEDFAVYYCMQHLEYPITFGAGTKLEIKGSHHHHHH

SEQ ID NO: 515 - protein, 248 aa, Artificial Sequence
  4G7_H1.52_L1.189_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLFSGVPDRFSGSGSGTEFTLTISSLEPEDFAVYYCMQHLEYPITFGAGTKLEIK

SEQ ID NO: 516 - protein, 256 aa, Artificial Sequence
  4G7_H1.52_L1.190_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLDSGVPDRFSGSGSGTEFTLTISSLEPEDFAVYYCMQHLEYPITFGAGTKLEIKGSHHHHHH

SEQ ID NO: 517 - protein, 248 aa, Artificial Sequence
  4G7_H1.52_L1.190_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLDSGVPDRFSGSGSGTEFTLTISSLEPEDFAVYYCMQHLEYPITFGAGTKLEIK

SEQ ID NO: 518 - protein, 256 aa, Artificial Sequence
  4G7_H1.52_L1.191_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLASGVPDRFSGSGSGTEFTLTISSLEPEDFAVYYCMQHLEYPITFGAGTKLEIKGSHHHHHH

SEQ ID NO: 519 - protein, 248 aa, Artificial Sequence
  4G7_H1.52_L1.191_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLASGVPDRFSGSGSGTEFTLTISSLEPEDFAVYYCMQHLEYPITFGAGTKLEIK

SEQ ID NO: 520 - protein, 256 aa, Artificial Sequence
  4G7_H1.52_L1.192_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTDFTLTISSLEPEDFAVYYCMQHLEYPITFGAGTKLEIKGSHHHHHH

SEQ ID NO: 521 - protein, 248 aa, Artificial Sequence
  4G7_H1.52_L1.192_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTDFTLTISSLEPEDFAVYYCMQHLEYPITFGAGTKLEIK

SEQ ID NO: 522 - protein, 256 aa, Artificial Sequence
  4G7_H1.52_L1.194_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGQGTKLEIKGSHHHHHH

SEQ ID NO: 523 - protein, 248 aa, Artificial Sequence
  4G7_H1.52_L1.194_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGQGTKLEIK

SEQ ID NO: 524 - protein, 256 aa, Artificial Sequence
  4G7_H1.52_L1.195_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGGGTKLEIKGSHHHHHH

SEQ ID NO: 525 - protein, 248 aa, Artificial Sequence
  4G7_H1.52_L1.195_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGGGTKLEIK

SEQ ID NO: 526 - protein, 259 aa, Artificial Sequence
  4G7_H1.52_alternate_linker_L1.155_scFv_6X-His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSVEGGSGGSGGSGGSGGVDDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 527 - protein, 251 aa, Artificial Sequence
  4G7_H1.52_alternate_linker_L1.155_scFv_no His
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSVEGGSGGSGGSGGSGGVDDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 528 - protein, 259 aa, Artificial Sequence
  4G7_L1.199_H1.227_20AA_linker_scFv_6X-His
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHH

SEQ ID NO: 529 - protein, 253 aa, Artificial Sequence
  4G7_L1.199_H1.227_20AA_linker_scFv_no His
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSS

SEQ ID NO: 530 - protein, 261 aa, Artificial Sequence
  4G7_H1.227_L1.198_20AA_linker_scFv_6X-His
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSGGGGSGGGGSGGGGSGGGGSDIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKGSHHHHHH

SEQ ID NO: 531 - protein, 253 aa, Artificial Sequence
  4G7_H1.227_L1.198_20AA_linker_scFv_no His
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSGGGGSGGGGSGGGGSGGGGSDIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIK

SEQ ID NO: 532 - protein, 261 aa, Artificial Sequence
  4G7_H1.226_L1.198_20AA_linker_scFv_6X-His
EVQLVESGGGLVKPGGSLKLSCAASGYTFTSYVMHWVRQAPGGGLEWIGYINPYNDGTKYNEKFKGRVTISSDKSISTAYMELSSLRSEDTAMYYCARGTYYYGTRVFDYWGQGTLVTVSSGGGGSGGGGSGGGGSGGGGSDIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKGSHHHHHH

SEQ ID NO: 533 - protein, 253 aa, Artificial Sequence
  4G7_H1.226_L1.198_20AA_linker_scFv_no His
EVQLVESGGGLVKPGGSLKLSCAASGYTFTSYVMHWVRQAPGGGLEWIGYINPYNDGTKYNEKFKGRVTISSDKSISTAYMELSSLRSEDTAMYYCARGTYYYGTRVFDYWGQGTLVTVSSGGGGSGGGGSGGGGSGGGGSDIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIK

SEQ ID NO: 534 - protein, 261 aa, Artificial Sequence
  4G7_L1.155_H1.52_20AA_linker_scFv_6X-His
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGSHHHHHH

SEQ ID NO: 535 - protein, 253 aa, Artificial Sequence
  4G7_L1.155_H1.52_20AA_linker_scFv_no His
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSS

SEQ ID NO: 536 - protein, 261 aa, Artificial Sequence
  4G7_L1.198_H1.226_20AA_linker_scFv_6X-His
DIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSISTAYMELSSLRSEDTAMYYCARGTYYYGTRVFDYWGQGTLVTVSSGSHHHHHH

SEQ ID NO: 537 - protein, 253 aa, Artificial Sequence
  4G7_L1.198_H1.226_20AA_linker_scFv_no His
DIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSISTAYMELSSLRSEDTAMYYCARGTYYYGTRVFDYWGQGTLVTVSS

SEQ ID NO: 538 - protein, 261 aa, Artificial Sequence
  4G7_L1.198_H1.227_20AA_linker_scFv_6X-His
DIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSGSHHHHHH

SEQ ID NO: 539 - protein, 253 aa, Artificial Sequence
  4G7_L1.198_H1.227_20AA_linker_scFv_no His
DIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSS

SEQ ID NO: 540 - protein, 261 aa, Artificial Sequence
  4G7_L1.200_H1.227_20AA_linker_scFv_6X-His
DIVMTQSPATLSLSPGERATISCRSSKSLQNVNGNTYLSWFQQKPGQSPKLLIYRMSNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSGSHHHHHH

SEQ ID NO: 541 - protein, 253 aa, Artificial Sequence
  4G7_L1.200_H1.227_20AA_linker_scFv_no His
DIVMTQSPATLSLSPGERATISCRSSKSLQNVNGNTYLSWFQQKPGQSPKLLIYRMSNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSS

SEQ ID NO: 542 - protein, 121 aa, Artificial Sequence
  Stabilized anti-CD19 Fv variants
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSS

SEQ ID NO: 543 - protein, 112 aa, Artificial Sequence
  Stabilized anti-CD19 Fv variants
DIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIK

SEQ ID NO: 544 - protein, 112 aa, Artificial Sequence
  Stabilized anti-CD19 Fv variants
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIK

SEQ ID NO: 545 - protein, 484 aa, Artificial Sequence
  Dual-scFv variants with stabilized anti-CD19 variable regions
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 546 - protein, 481 aa, Artificial Sequence
  Dual-scFv variants with stabilized anti-CD19 variable regions
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - protein, 484 aa, Artificial Sequence
  Dual-scFv variants with stabilized anti-CD19 variable regions
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSGGGGSGGGGSGGGGSGGGGSDIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 548 - protein, 481 aa, Artificial Sequence; identical to SEQ ID NO: 546
  Dual-scFv variants with stabilized anti-CD19 variable regions

SEQ ID NO: 549 - protein, 450 aa, Artificial Sequence
  Bottle-opener variants with stabilized anti-CD19 Fvs
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 550 - protein, 481 aa, Artificial Sequence; identical to SEQ ID NO: 546
  Bottle-opener variants with stabilized anti-CD19 Fvs

SEQ ID NO: 551 - protein, 219 aa, Artificial Sequence
  Bottle-opener variants with stabilized anti-CD19 Fvs
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 552 - protein, 450 aa, Artificial Sequence; identical to SEQ ID NO: 549
  Bottle-opener variants with stabilized anti-CD19 Fvs

SEQ ID NO: 553 - protein, 481 aa, Artificial Sequence; identical to SEQ ID NO: 546
  Bottle-opener variants with stabilized anti-CD19 Fvs

SEQ ID NO: 554 - protein, 219 aa, Artificial Sequence
  Bottle-opener variants with stabilized anti-CD19 Fvs
DIVMTQSPATLSLSPGERATISCRSSKSLQNVNGNTYLYWFQQKPGQSPKLLIYRMSNLNSGVPDRFSGSGSGTEFTLTISSLEPEDFAVYYCMQHLEYPITFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 555 - protein, 15 aa, Artificial Sequence
  CD3_H1.30_L1.47_scFv_His
GGGGSGGGGSGGGGS

SEQ ID NO: 556 - protein, 14 aa, Artificial Sequence
  CD3_H1.30_L1.47_scFv_His_scFvLinker(+A)
IRPRAIGGSKPRVA

SEQ ID NO: 557 - protein, 15 aa, Artificial Sequence
  CD3_H1.30_L1.47_scFv_His_scFvLinker(+B)
GKGGSGKGGSGKGGS

SEQ ID NO: 558 - protein, 15 aa, Artificial Sequence
  CD3_H1.30_L1.47_scFv_His_scFvLinker(+C)
GGKGSGGKGSGGKGS

SEQ ID NO: 559 - protein, 15 aa, Artificial Sequence
  CD3_H1.30_L1.47_scFv_His_scFvLinker(+D)
GGGKSGGGKSGGGKS

SEQ ID NO: 560 - protein, 15 aa, Artificial Sequence
  CD3_H1.30_L1.47_scFv_His_scFvLinker(+E)
GKGKSGKGKSGKGKS

SEQ ID NO: 561 - protein, 15 aa, Artificial Sequence
  CD3_H1.30_L1.47_scFv_His_scFvLinker(+F)
GGGKSGGKGSGKGGS

SEQ ID NO: 562 - protein, 15 aa, Artificial Sequence
  CD3_H1.30_L1.47_scFv_His_scFvLinker(+G)
GKPGSGKPGSGKPGS

SEQ ID NO: 563 - protein, 20 aa, Artificial Sequence
  CD3_H1.30_L1.47_scFv_His_scFvLinker(+H)
GKPGSGKPGSGKPGSGKPGS

SEQ ID NO: 564 - protein, 20 aa, Artificial Sequence
  CD3_H1.30_L1.47_scFv_His_scFvLinker(+I)
GKGKSGKGKSGKGKSGKGKS

SEQ ID NO: 565 - protein, 20 aa, Artificial Sequence
  4G7_L1.199_H1.227_20AA_linker_scFv_6X-His
GGGGSGGGGSGGGGSGGGGS

SEQ ID NO: 566 - protein, 14 aa, Artificial Sequence
  4G7_L1.199_H1.227_14AA_linker_(-A)_scFv_6X-His
STAGDTHLGGEDFD

SEQ ID NO: 567 - protein, 15 aa, Artificial Sequence
  4G7_L1.199_H1.227_15AA_linker_(-B)_scFv_6X-His
GEGGSGEGGSGEGGS

SEQ ID NO: 568 - protein, 15 aa, Artificial Sequence
  4G7_L1.199_H1.227_15AA_linker_(-C)_scFv_6X-His
GGEGSGGEGSGGEGS

SEQ ID NO: 569 - protein, 15 aa, Artificial Sequence
  4G7_L1.199_H1.227_15AA_linker_(-D)_scFv_6X-His
GGGESGGGESGGGES

SEQ ID NO: 570 - protein, 15 aa, Artificial Sequence
  4G7_L1.199_H1.227_15AA_linker_(-E)_scFv_6X-His
GEGESGEGESGEGES

SEQ ID NO: 571 - protein, 15 aa, Artificial Sequence
  4G7_L1.199_H1.227_15AA_linker_(-F)_scFv_6X-His
GGGESGGEGSGEGGS

SEQ ID NO: 572 - protein, 20 aa, Artificial Sequence
  4G7_L1.199_H1.227_20AA_linker_(-G)_scFv_6X-His
GEGESGEGESGEGESGEGES

SEQ ID NO: 573 - protein, 261 aa, Artificial Sequence
  XENP11869 (4G7_L1.199_H1.227_20AA_linker_scFv_6X-His
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 574 - protein, 255 aa, Artificial Sequence
  XENP11869 (4G7_L1.199_H1.227_20AA_linker_scFv_6X-His
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGGSGGGGSGGGGSGGGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 575 - protein, 257 aa, Artificial Sequence; identical to SEQ ID NO: 395
  XENP12241 (CD3_H1.30_L1.47_scFv_His)

SEQ ID NO: 576 - protein, 251 aa, Artificial Sequence
  XENP12241 (CD3_H1.30_L1.47_scFv_His)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 577 - protein, 450 aa, Artificial Sequence; identical to SEQ ID NO: 549
  XENP12482

SEQ ID NO: 578 - protein, 481 aa, Artificial Sequence
  XENP12482
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 219 aa, Artificial Sequence; identical to SEQ ID NO: 551
  XENP12482

SEQ ID NO: 580 - protein, 256 aa, Artificial Sequence
  XENP12782 (CD3_H1.30_L1.47_scFv_His_scFvLinker(+A))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSIRPRAIGGSKPRVAQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 581 - protein, 256 aa, Artificial Sequence; identical to SEQ ID NO: 580
  XENP12782 (CD3_H1.30_L1.47_scFv_His_scFvLinker(+A))

SEQ ID NO: 582 - protein, 257 aa, Artificial Sequence
  XENP12783 (CD3_H1.30_L1.47_scFv_His_scFvLinker(+B))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGGSGKGGSGKGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 583 - protein, 251 aa, Artificial Sequence
  XENP12783 (CD3_H1.30_L1.47_scFv_His_scFvLinker(+B))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGGSGKGGSGKGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 584 - protein, 257 aa, Artificial Sequence
  XENP12784 (CD3_H1.30_L1.47_scFv_His_scFvLinker(+C))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGKGSGGKGSGGKGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 585 - protein, 251 aa, Artificial Sequence
  XENP12784 (CD3_H1.30_L1.47_scFv_His_scFvLinker(+C))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGKGSGGKGSGGKGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 586 - protein, 257 aa, Artificial Sequence
  XENP12785 (CD3_H1.30_L1.47_scFv_His_scFvLinker(+D))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGKSGGGKSGGGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 587 - protein, 251 aa, Artificial Sequence
  XENP12785 (CD3_H1.30_L1.47_scFv_His_scFvLinker(+D))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGKSGGGKSGGGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 588 - protein, 257 aa, Artificial Sequence
  XENP12786 (CD3_H1.30_L1.47_scFv_His_scFvLinker(+E))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGKSGKGKSGKGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 589 - protein, 251 aa, Artificial Sequence
  XENP12786 (CD3_H1.30_L1.47_scFv_His_scFvLinker(+E))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGKSGKGKSGKGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 590 - protein, 257 aa, Artificial Sequence
  XENP12787 (CD3_H1.30_L1.47_scFv_His_scFvLinker(+F))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGKSGGKGSGKGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 591 - protein, 251 aa, Artificial Sequence
  XENP12787 (CD3_H1.30_L1.47_scFv_His_scFvLinker(+F))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGKSGGKGSGKGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 592 - protein, 257 aa, Artificial Sequence
  XENP12788 (CD3_H1.30_L1.47_scFv_His_scFvLinker(+G))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 593 - protein, 251 aa, Artificial Sequence
  XENP12788 (CD3_H1.30_L1.47_scFv_His_scFvLinker(+G))
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 594 - protein, 262 aa, Artificial Sequence
  XENP12789
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 595 - protein, 256 aa, Artificial Sequence
  XENP12789
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 596 - protein, 262 aa, Artificial Sequence
  XENP12790
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGKSGKGKSGKGKSGKGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 597 - protein, 256 aa, Artificial Sequence
  XENP12790
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGKSGKGKSGKGKSGKGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGS

SEQ ID NO: 598 - protein, 255 aa, Artificial Sequence
  XENP12791
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKSTAGDTHLGGEDFDEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 599 - protein, 249 aa, Artificial Sequence
  XENP12791
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKSTAGDTHLGGEDFDEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 600 - protein, 256 aa, Artificial Sequence
  XENP12792
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGEGGSGEGGSGEGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 601 - protein, 250 aa, Artificial Sequence
  XENP12792
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGEGGSGEGGSGEGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 602 - protein, 256 aa, Artificial Sequence
  XENP12793
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGEGSGGEGSGGEGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 603 - protein, 250 aa, Artificial Sequence
  XENP12793
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGEGSGGEGSGGEGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 604 - protein, 256 aa, Artificial Sequence
  XENP12794
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGESGGRESGGGESEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 605 - protein, 250 aa, Artificial Sequence
  XENP12794
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGESGGRESGGGESEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 606 - protein, 256 aa, Artificial Sequence
  XENP12795
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGEGESGEGESGEGESEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 607 - protein, 250 aa, Artificial Sequence
  XENP12795
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGEGESGEGESGEGESEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 608 - protein, 255 aa, Artificial Sequence
  Single chain Fv
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGESGGEGSGEGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHH

SEQ ID NO: 609 - protein, 250 aa, Artificial Sequence
  Single chain Fv
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGGGESGGEGSGEGGSEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 610 - protein, 261 aa, Artificial Sequence
  XENP12801
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGEGESGEGESGEGESGEGESEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSGHHHHHH

SEQ ID NO: 611 - protein, 255 aa, Artificial Sequence
  XENP12801
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKGEGESGEGESGEGESGEGESEVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSSG

SEQ ID NO: 612 - protein, 449 aa, Artificial Sequence
  XENP12968
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPPVAGPSVFLFPPKPKDTLMISRTPEVTCVVVDVKHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCDVSGFYPSDIAVEWESNGQPENNYKTTPPVLDSDGSFFLYSKLTVDKSRWQEGNVFSCSVMHEALHNHYTQKSLSLSPG

SEQ ID NO: 613 - protein, 480 aa, Artificial Sequence
  XENP12968
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 614 - protein, 219 aa, Artificial Sequence; identical to SEQ ID NO: 551
  XENP12968

SEQ ID NO: 615 - protein, 450 aa, Artificial Sequence
  XENP13121
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 616 - protein, 478 aa, Artificial Sequence
  XENP13121
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSP

SEQ ID NO: 617 - protein, 219 aa, Artificial Sequence; identical to SEQ ID NO: 551
  XENP13121

SEQ ID NO: 618 - protein, 450 aa, Artificial Sequence; identical to SEQ ID NO: 615
  XENP13122

SEQ ID NO: 619 - protein, 480 aa, Artificial Sequence
  XENP13122
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGGSGKGGSGKGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 218 aa, Artificial Sequence
  XENP13122
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 621 - protein, 450 aa, Artificial Sequence; identical to SEQ ID NO: 615
  XENP13123

SEQ ID NO: 622 - protein, 480 aa, Artificial Sequence
  XENP13123
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 219 aa, Artificial Sequence; identical to SEQ ID NO: 551
  XENP13123

SEQ ID NO: 624 - protein, 450 aa, Artificial Sequence; identical to SEQ ID NO: 615
  XENP13124

SEQ ID NO: 625 - protein, 485 aa, Artificial Sequence
  XENP13124
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 626 - protein, 219 aa, Artificial Sequence; identical to SEQ ID NO: 551
  XENP13124

SEQ ID NO: 627 - protein, 450 aa, Artificial Sequence; identical to SEQ ID NO: 615
  XENP13125

SEQ ID NO: 628 - protein, 480 aa, Artificial Sequence
  XENP13125
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKGKSGKGKSGKGKSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 629 - protein, 219 aa, Artificial Sequence; identical to SEQ ID NO: 551
  XENP13125

SEQ ID NO: 630 - protein, 450 aa, Artificial Sequence; identical to SEQ ID NO: 615
  XENP13126

SEQ ID NO: 631 - protein, 485 aa, Artificial Sequence
  XENP13126
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHQDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 632 - protein, 219 aa, Artificial Sequence; identical to SEQ ID NO: 551
  XENP13126

SEQ ID NO: 633 - protein, 453 aa, Artificial Sequence
  XENP4547 (Bevacizumab - Avastin - IgG1 WT)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 634 - protein, 214 aa, Artificial Sequence
  Light chain (Bevacizumab Avastin L0)
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 635 - protein, 453 aa, Artificial Sequence
  XENP12774 (Bevacizumab_IgG1_pI(-)_Isosteric_A)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHEALHNHYTQKSLSLSPGK

SEQ ID NO: 636 - protein, 214 aa, Artificial Sequence; identical to SEQ ID NO: 634
  XENP12774 (Bevacizumab_IgG1_pI(-)_Isosteric_A)

SEQ ID NO: 637 - protein, 453 aa, Artificial Sequence
  XENP12775 (Bevacizumab_IgG1_pI(-)_Isosteric_B)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWEQGDVFSCSVMHEALHNHYTQKSLSLSPGK

SEQ ID NO: 638 - protein, 214 aa, Artificial Sequence; identical to SEQ ID NO: 634
  XENP12775 (Bevacizumab_IgG1_pI(-)_Isosteric_B)

SEQ ID NO: 639 - protein, 453 aa, Artificial Sequence
  XENP12776 (Bevacizumab_IgG1_pI(+)_Isosteric_A)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHQDPQVKFKWYVDGVQVHNAKTKPREEQYNSTYRVVSVLTVLHQDWLNGKEYKCKVSNKALPAPIEKTISKAKGQPREPQVYTLPPSREQMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 640 - protein, 214 aa, Artificial Sequence; identical to SEQ ID NO: 634
  XENP12776 (Bevacizumab_IgG1_pI(+)_Isosteric_A)

SEQ ID NO: 641 - protein, 453 aa, Artificial Sequence
  XENP12777 (Bevacizumab_IgG1_pI(+)_Isosteric_B)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHQDPQVKFNWYVDGVQVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 214 aa, Artificial Sequence; identical to SEQ ID NO: 634
  XENP12777 (Bevacizumab_IgG1_pI(+)_Isosteric_B)

SEQ ID NO: 643 - protein, 453 aa, Artificial Sequence; identical to SEQ ID NO: 635
  XENP12778

SEQ ID NO: 644 - protein, 453 aa, Artificial Sequence; identical to SEQ ID NO: 639
  XENP12778

SEQ ID NO: 645 - protein, 214 aa, Artificial Sequence; identical to SEQ ID NO: 634
  XENP12778

SEQ ID NO: 646 - protein, 453 aa, Artificial Sequence; identical to SEQ ID NO: 635
  XENP12779

SEQ ID NO: 647 - protein, 453 aa, Artificial Sequence; identical to SEQ ID NO: 641
  XENP12779

SEQ ID NO: 648 - protein, 214 aa, Artificial Sequence; identical to SEQ ID NO: 634
  XENP12779

SEQ ID NO: 649 - protein, 453 aa, Artificial Sequence; identical to SEQ ID NO: 637
  XENP12780

SEQ ID NO: 650 - protein, 453 aa, Artificial Sequence; identical to SEQ ID NO: 639
  XENP12780

SEQ ID NO: 651 - protein, 214 aa, Artificial Sequence; identical to SEQ ID NO: 634
  XENP12780

SEQ ID NO: 652 - protein, 453 aa, Artificial Sequence; identical to SEQ ID NO: 637
  XENP12781

SEQ ID NO: 653 - protein, 453 aa, Artificial Sequence; identical to SEQ ID NO: 641
  XENP12781

SEQ ID NO: 654 - protein, 214 aa, Artificial Sequence; identical to SEQ ID NO: 634
  XENP12781

SEQ ID NO: 655 - protein, 232 aa, Artificial Sequence
  XENP12876
EPKSSDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHEALHNHYTQKSLSLSPGK

SEQ ID NO: 656 - protein, 232 aa, Artificial Sequence
  XENP12876
EPKSSDKTHTCPPCPAPELLGGPSVFLFPPKPKDTLMISRTPEVTCVVVDVSHQDPQVKFNWYVDGVQVHNAKTKPREEQYNSTYRVVSVLTVLHQDWLNGKEYKCKVSNKALPAPIEKTISKAKGQPREPQVYTLPPSREQMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 657 - protein, 232 aa, Artificial Sequence; identical to SEQ ID NO: 655
  XENP12877

SEQ ID NO: 658 - protein, 232 aa, Artificial Sequence
  XENP12877
EPKSSDKTHTCPPCPAPELLGGPSVFLFPPKPKDTLMISRTPEVTCVVVDVSHQDPQVKFNWYVDGVQVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - protein, 232 aa, Artificial Sequence
  XENP12878
EPKSSDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWEQGDVFSCSVMHEALHNHYTQKSLSLSPGK

SEQ ID NO: 660 - protein, 232 aa, Artificial Sequence; identical to SEQ ID NO: 656
  XENP12878

SEQ ID NO: 661 - protein, 232 aa, Artificial Sequence; identical to SEQ ID NO: 659
  XENP12879

SEQ ID NO: 662 - protein, 232 aa, Artificial Sequence; identical to SEQ ID NO: 658
  XENP12879

SEQ ID NO: 663 - protein, 453 aa, Artificial Sequence
  XENP12948
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPQVKFNWYVDGVQVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 664 - protein, 214 aa, Artificial Sequence; identical to SEQ ID NO: 634
  XENP12948

SEQ ID NO: 665 - protein, 453 aa, Artificial Sequence
  XENP12949
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHQDPEVKFNWYVDGVQVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 666 - protein, 214 aa, Artificial Sequence; identical to SEQ ID NO: 634
  XENP12949

SEQ ID NO: 667 - protein, 453 aa, Artificial Sequence
  XENP12950
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHQDPQVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 668 - protein, 214 aa, Artificial Sequence; identical to SEQ ID NO: 634
  XENP12950

SEQ ID NO: 669 - protein, 453 aa, Artificial Sequence
  XENP12951
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHQDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 670 - protein, 214 aa, Artificial Sequence; identical to SEQ ID NO: 634
  XENP12951

SEQ ID NO: 671 - protein, 232 aa, Artificial Sequence
  XENP12952
EPKSSDKTHTCPPCPAPELLGGPSVFLFPPKPKDTLMISRTPEVTCVVVDVSHEDPQVKFNWYVDGVQVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 672 - protein, 232 aa, Artificial Sequence
  XENP12953
EPKSSDKTHTCPPCPAPELLGGPSVFLFPPKPKDTLMISRTPEVTCVVVDVSHQDPEVKFNWYVDGVQVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - protein, 232 aa, Artificial Sequence
  XENP12954
EPKSSDKTHTCPPCPAPELLGGPSVFLFPPKPKDTLMISRTPEVTCVVVDVSHQDPQVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 674 - protein, 232 aa, Artificial Sequence
  XENP12955
EPKSSDKTHTCPPCPAPELLGGPSVFLFPPKPKDTLMISRTPEVTCVVVDVSHQDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 450 aa, Artificial Sequence
  XENP13228
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHEALHNHYTQKSLSLSPGK

SEQ ID NO: 676 - protein, 480 aa, Artificial Sequence
  XENP13228
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 677 - protein, 219 aa, Artificial Sequence; identical to SEQ ID NO: 551
  XENP13228

SEQ ID NO: 678 - protein, 15 aa, Artificial Sequence
  scFv Linkers
GGGGSGGGGSGGGGS

SEQ ID NO: 679 - protein, 20 aa, Artificial Sequence
  scFv Linkers
GGGGSGGGGSGGGGSGGGGS

SEQ ID NO: 680 - protein, 18 aa, Artificial Sequence
  scFv Linkers
GSTSGSGKPGSGEGSTKG

SEQ ID NO: 681 - protein, 19 aa, Artificial Sequence
  scFv Linkers
PRGASKSGSASQTGSAPGS

SEQ ID NO: 682 - protein, 19 aa, Artificial Sequence
  scFv Linkers
GTAAAGAGAAGGAAAGAAG

SEQ ID NO: 683 - protein, 19 aa, Artificial Sequence
  scFv Linkers
GTSGSSGSGSGGSGSGGGG

SEQ ID NO: 684 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 685 - protein, 257 aa, Artificial Sequence
  XENP12912 H1.79_L1.48
EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGCGTKLTVLGSHHHHHH

SEQ ID NO: 686 - protein, 249 aa, Artificial Sequence
  XENP12912 H1.79_L1.48
EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGCGTKLTVL

SEQ ID NO: 687 - protein, 125 aa, Artificial Sequence
  XENP12912 H1.79_L1.48
EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDSYVSWFAYWGQGTLVTVSS

SEQ ID NO: 688 - protein, 109 aa, Artificial Sequence
  XENP12912 H1.79_L1.48
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGCGTKLTVL

SEQ ID NO: 689 - protein, 257 aa, Artificial Sequence
  XENP13701 H1.80_L1.49
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGCGTLVTVSSGGGGSGGGGSGGGGSQAVVTQEPSLTVSPGGTVTLTCGSSTGAVTTSNYANWVQQKPGKCPRGLIGGTNKRAPGVPARFSGSLLGGKAALTISGAQPEDEADYYCALWYSNHWVFGGGTKLTVLGSHHHHHH

SEQ ID NO: 690 - protein, 249 aa, Artificial Sequence
  XENP13701 H1.80_L1.49
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGCGTLVTVSSGGGGSGGGGSGGGGSQAVVTQEPSLTVSPGGTVTLTCGSSTGAVTTSNYANWVQQKPGKCPRGLIGGTNKRAPGVPARFSGSLLGGKAALTISGAQPEDEADYYCALWYSNHWVFGGGTKLTVL

SEQ ID NO: 691 - protein, 125 aa, Artificial Sequence
  XENP13701 H1.80_L1.49
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGCGTLVTVSS

SEQ ID NO: 692 - protein, 109 aa, Artificial Sequence
  XENP13701 H1.80_L1.49
QAVVTQEPSLTVSPGGTVTLTCGSSTGAVTTSNYANWVQQKPGKCPRGLIGGTNKRAPGVPARFSGSLLGGKAALTISGAQPEDEADYYCALWYSNHWVFGGGTKLTVL

SEQ ID NO: 693 - protein, 257 aa, Artificial Sequence
  XENP13702 H1.81_L1.50
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSCVSWFAYWGQGTLVTVSSGGGGSGGGGSGGGGSQAVVTQEPSLTVSPGGTVTLTCGSSTGAVTTSNYANWVQQKPGKSPRGLICGTNKRAPGVPARFSGSLLGGKAALTISGAQPEDEADYYCALWYSNHWVFGGGTKLTVLGSHHHHHH

SEQ ID NO: 694 - protein, 249 aa, Artificial Sequence
  XENP13702 H1.81_L1.50
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSCVSWFAYWGQGTLVTVSSGGGGSGGGGSGGGGSQAVVTQEPSLTVSPGGTVTLTCGSSTGAVTTSNYANWVQQKPGKSPRGLICGTNKRAPGVPARFSGSLLGGKAALTISGAQPEDEADYYCALWYSNHWVFGGGTKLTVL

SEQ ID NO: 695 - protein, 125 aa, Artificial Sequence
  XENP13702 H1.81_L1.50
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSCVSWFAYWGQGTLVTVSS

SEQ ID NO: 696 - protein, 109 aa, Artificial Sequence
  XENP13702 H1.81_L1.50
QAVVTQEPSLTVSPGGTVTLTCGSSTGAVTTSNYANWVQQKPGKSPRGLICGTNKRAPGVPARFSGSLLGGKAALTISGAQPEDEADYYCALWYSNHWVFGGGTKLTVL

SEQ ID NO: 697 - protein, 257 aa, Artificial Sequence
  XENP13703 H1.81_L1.51
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSCVSWFAYWGQGTLVTVSSGGGGSGGGGSGGGGSQAVVTQEPSLTVSPGGTVTLTCGSSTGAVTTSNYANWVQQKPGKSPRGLIGCTNKRAPGVPARFSGSLLGGKAALTISGAQPEDEADYYCALWYSNHWVFGGGTKLTVLGSHHHHHH

SEQ ID NO: 698 - protein, 249 aa, Artificial Sequence
  XENP13703 H1.81_L1.51
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSCVSWFAYWGQGTLVTVSSGGGGSGGGGSGGGGSQAVVTQEPSLTVSPGGTVTLTCGSSTGAVTTSNYANWVQQKPGKSPRGLIGCTNKRAPGVPARFSGSLLGGKAALTISGAQPEDEADYYCALWYSNHWVFGGGTKLTVL

SEQ ID NO: 699 - protein, 125 aa, Artificial Sequence; identical to SEQ ID NO: 695
  XENP13703 H1.81_L1.51

SEQ ID NO: 700 - protein, 109 aa, Artificial Sequence
  XENP13703 H1.81_L1.51
QAVVTQEPSLTVSPGGTVTLTCGSSTGAVTTSNYANWVQQKPGKSPRGLIGCTNKRAPGVPARFSGSLLGGKAALTISGAQPEDEADYYCALWYSNHWVFGGGTKLTVL

SEQ ID NO: 701 - protein, 257 aa, Artificial Sequence
  XENP13704 H1.82_L1.51
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGCSYVSWFAYWGQGTLVTVSSGGGGSGGGGSGGGGSQAVVTQEPSLTVSPGGTVTLTCGSSTGAVTTSNYANWVQQKPGKSPRGLIGCTNKRAPGVPARFSGSLLGGKAALTISGAQPEDEADYYCALWYSNHWVFGGGTKLTVLGSHHHHHH

SEQ ID NO: 702 - protein, 249 aa, Artificial Sequence
  XENP13704 H1.82_L1.51
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGCSYVSWFAYWGQGTLVTVSSGGGGSGGGGSGGGGSQAVVTQEPSLTVSPGGTVTLTCGSSTGAVTTSNYANWVQQKPGKSPRGLIGCTNKRAPGVPARFSGSLLGGKAALTISGAQPEDEADYYCALWYSNHWVFGGGTKLTVL

SEQ ID NO: 703 - protein, 125 aa, Artificial Sequence
  XENP13704 H1.82_L1.51
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGCSYVSWFAYWGQGTLVTVSS

SEQ ID NO: 704 - protein, 109 aa, Artificial Sequence; identical to SEQ ID NO: 700
  XENP13704 H1.82_L1.51

SEQ ID NO: 705 - protein, 257 aa, Artificial Sequence
  XENP13705 H1.83_L1.52
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFCYWGQGTLVTVSSGGGGSGGGGSGGGGSQAVVTQEPSLTVSPGGTVTLTCGSSTGAVTTSNYANWVQQKPGKSPRCLIGGTNKRAPGVPARFSGSLLGGKAALTISGAQPEDEADYYCALWYSNHWVFGGGTKLTVLGSHHHHHH

SEQ ID NO: 706 - protein, 249 aa, Artificial Sequence
  XENP13705 H1.83_L1.52
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFCYWGQGTLVTVSSGGGGSGGGGSGGGGSQAVVTQEPSLTVSPGGTVTLTCGSSTGAVTTSNYANWVQQKPGKSPRCLIGGTNKRAPGVPARFSGSLLGGKAALTISGAQPEDEADYYCALWYSNHWVFGGGTKLTVL

SEQ ID NO: 707 - protein, 125 aa, Artificial Sequence
  XENP13705 H1.83_L1.52
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFCYWGQGTLVTVSS

SEQ ID NO: 708 - protein, 109 aa, Artificial Sequence
  XENP13705 H1.83_L1.52
QAVVTQEPSLTVSPGGTVTLTCGSSTGAVTTSNYANWVQQKPGKSPRCLIGGTNKRAPGVPARFSGSLLGGKAALTISGAQPEDEADYYCALWYSNHWVFGGGTKLTVL

SEQ ID NO: 709 - protein, 257 aa, Artificial Sequence
  XENP13706 H1.84_L1.53
EVQLVESGGGLVQPGGSLRLSCAASGFTFSTYAMNWVRCAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQCKPGKSPRGLIGGTNKRAPGVPARFSGSLLGGKAALTISGAQPEDEADYYCALWYSNHWVFGGGTKLTVLGSHHHHHH

SEQ ID NO: 710 - protein, 249 aa, Artificial Sequence
  XENP13706 H1.84_L1.53
EVQLVESGGGLVQPGGSLRLSCAASGFTFSTYAMNWVRCAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQCKPGKSPRGLIGGTNKRAPGVPARFSGSLLGGKAALTISGAQPEDEADYYCALWYSNHWVFGGGTKLTVL

SEQ ID NO: 711 - protein, 125 aa, Artificial Sequence
  XENP13706 H1.84_L1.53
EVQLVESGGGLVQPGGSLRLSCAASGFTFSTYAMNWVRCAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 712 - protein, 109 aa, Artificial Sequence
  XENP13706 H1.84_L1.53
QAVVTQEPSLTVSPGGTVTLTCGSSTGAVTTSNYANWVQCKPGKSPRGLIGGTNKRAPGVPARFSGSLLGGKAALTISGAQPEDEADYYCALWYSNHWVFGGGTKLTVL

SEQ ID NO: 713 - protein, 257 aa, Artificial Sequence
  XENP13707 H1.85_L1.54
EVQLVESGGGLVQPGGSLRLSCAASGFTFSTYAMNWVRQAPGKGLEWVGRIRSKYNNYATYYADSVKGRFTISRDDSKNTLYLQMNSLRAEDTACYYCVRHGNFGDSYVSWFAYWGQGTLVTVSSGGGGSGGGGSGGGGSQAVVTQEPSLTVSPGGTVTLTCGSSTGAVTTSNYANWVQQKPGCSPRGLIGGTNKRAPGVPARFSGSLLGGKAALTISGAQPEDEADYYCALWYSNHWVFGGGTKLTVLGSHHHHHH

SEQ ID NO: 714 - protein, 249 aa, Artificial Sequence
  XENP13707 H1.85_L1.54
EVQLVESGGGLVQPGGSLRLSCAASGFTFSTYAMNWVRQAPGKGLEWVGRIRSKYNNYATYYADSVKGRFTISRDDSKNTLYLQMNSLRAEDTACYYCVRHGNFGDSYVSWFAYWGQGTLVTVSSGGGGSGGGGSGGGGSQAVVTQEPSLTVSPGGTVTLTCGSSTGAVTTSNYANWVQQKPGCSPRGLIGGTNKRAPGVPARFSGSLLGGKAALTISGAQPEDEADYYCALWYSNHWVFGGGTKLTVL

SEQ ID NO: 715 - protein, 125 aa, Artificial Sequence
  XENP13707 H1.85_L1.54
EVQLVESGGGLVQPGGSLRLSCAASGFTFSTYAMNWVRQAPGKGLEWVGRIRSKYNNYATYYADSVKGRFTISRDDSKNTLYLQMNSLRAEDTACYYCVRHGNFGDSYVSWFAYWGQGTLVTVSS

SEQ ID NO: 716 - protein, 109 aa, Artificial Sequence
  XENP13707 H1.85_L1.54
QAVVTQEPSLTVSPGGTVTLTCGSSTGAVTTSNYANWVQQKPGCSPRGLIGGTNKRAPGVPARFSGSLLGGKAALTISGAQPEDEADYYCALWYSNHWVFGGGTKLTVL

SEQ ID NO: 717 - protein, 257 aa, Artificial Sequence
  XENP13708 H1.86_L1.55
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYCSWFAYWGQGTLVTVSSGGGGSGGGGSGGGGSQAVVTQEPSLTVSPGGTVTLTCGSSTGAVTTSNYANWVQQKPGKSPRGLIGGTNCRAPGVPARFSGSLLGGKAALTISGAQPEDEADYYCALWYSNHWVFGGGTKLTVLGSHHHHHH

SEQ ID NO: 718 - protein, 249 aa, Artificial Sequence
  XENP13708 H1.86_L1.55
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYCSWFAYWGQGTLVTVSSGGGGSGGGGSGGGGSQAVVTQEPSLTVSPGGTVTLTCGSSTGAVTTSNYANWVQQKPGKSPRGLIGGTNCRAPGVPARFSGSLLGGKAALTISGAQPEDEADYYCALWYSNHWVFGGGTKLTVL

SEQ ID NO: 719 - protein, 125 aa, Artificial Sequence
  XENP13708 H1.86_L1.55
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYCSWFAYWGQGTLVTVSS

SEQ ID NO: 720 - protein, 109 aa, Artificial Sequence
  XENP13708 H1.86_L1.55
QAVVTQEPSLTVSPGGTVTLTCGSSTGAVTTSNYANWVQQKPGKSPRGLIGGTNCRAPGVPARFSGSLLGGKAALTISGAQPEDEADYYCALWYSNHWVFGGGTKLTVL

SEQ ID NO: 721 - protein, 257 aa, Artificial Sequence
  XENP13709 H1.83_L1.56
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFCYWGQGTLVTVSSGGGGSGGGGSGGGGSQAVVTQEPSLTVSPGGTVTLTCGSSTGAVTTSNYANWVQQKPGKSPRGLIGGTNKRCPGVPARFSGSLLGGKAALTISGAQPEDEADYYCALWYSNHWVFGGGTKLTVLGSHHHHHH

SEQ ID NO: 722 - protein, 249 aa, Artificial Sequence
  XENP13709 H1.83_L1.56
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFCYWGQGTLVTVSSGGGGSGGGGSGGGGSQAVVTQEPSLTVSPGGTVTLTCGSSTGAVTTSNYANWVQQKPGKSPRGLIGGTNKRCPGVPARFSGSLLGGKAALTISGAQPEDEADYYCALWYSNHWVFGGGTKLTVL

SEQ ID NO: 723 - protein, 125 aa, Artificial Sequence; identical to SEQ ID NO: 707
  XENP13709 H1.83_L1.56

SEQ ID NO: 724 - protein, 109 aa, Artificial Sequence
  XENP13709 H1.83_L1.56
QAVVTQEPSLTVSPGGTVTLTCGSSTGAVTTSNYANWVQQKPGKSPRGLIGGTNKRCPGVPARFSGSLLGGKAALTISGAQPEDEADYYCALWYSNHWVFGGGTKLTVL

SEQ ID NO: 725 - protein, 256 aa, Artificial Sequence
  4G7_H1.219_L1.155_scFv_6X-His
EVQLVESGGGLVKPGGSLKLSCAASGYTFTSYVMHWVRQAPGKGLEWIGYINPYNGGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 726 - protein, 248 aa, Artificial Sequence
  4G7_H1.219_L1.155_scFv_no His
EVQLVESGGGLVKPGGSLKLSCAASGYTFTSYVMHWVRQAPGKGLEWIGYINPYNGGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 727 - protein, 256 aa, Artificial Sequence
  4G7_H1.221_L1.155_scFv_6X-His
EVQLVESGGGLVKPGGSLKLSCAASGYTFTSYVMHWVRQAPGKGLEWIGYINPYNDGTKYNEKFQGRVTISSDKSISTAYMEMSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 728 - protein, 256 aa, Artificial Sequence
  4G7_H1.222_L1.155_scFv_6X-His
EVQLVESGGGLVKPGGSLKLSCAASGYTFTSYGMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGSHHHHHH

SEQ ID NO: 729 - protein, 18 aa, Artificial Sequence
  4G7_H1.52_alternate_linker_L1.155_scFv_6X-His
VEGGSGGSGGSGGSGGVD

SEQ ID NO: 730 - protein, 4 aa, Artificial Sequence
  sequence linker
GFLG

What is claimed is:

1. A nucleic acid composition comprising a nucleic acid encoding an anti-CD3 scFv, the anti-CD3 scFv comprising:
    a) a variable heavy chain comprising a vhCDR1 having the amino acid sequence of SEQ ID NO:411; a vhCDR2 having the amino acid sequence of SEQ ID NO: 413; and a vhCDR3 having the amino acid sequence of SEQ ID NO: 417;
    b) a variable light chain comprising a vlCDR1 having the amino acid sequence of SEQ ID NO: 420; a vlCDR2 having the amino acid sequence of SEQ ID NO: 425; and a vlCDR3 having the amino acid sequence of SEQ ID NO: 433; and
    c) a charged scFv linker, wherein the charged scFv linker covalently attaches the variable heavy chain and the variable light chain.

2. A nucleic acid composition according to claim 1, wherein the variable heavy chain has the amino acid sequence of SEQ ID NO: 397; and a variable light chain has the amino acid sequence of SEQ ID NO: 398.

3. A nucleic acid composition comprising a nucleic acid encoding an anti-CD3 scFv, the anti-CD3 scFv comprising:
    a) a first variable heavy chain comprising a vhCDR1, vhCDR2 and vhCDR3 of a variable heavy chain having the amino acid sequence SEQ ID NO:397; and
    b) a variable light chain comprising a vlCDR1, vlCDR2 and vlCDR3 of a variable light chain having the amino acid sequence of SEQ ID NO:398.

4. An expression vector comprising the nucleic acid of any one of claims 1 to 3.

5. A host cell comprising the expression vector of claim 4.

6. A method of making an anti-CD3 scFv comprising culturing the host cell of claim 5 under conditions wherein the anti-CD3 scFv is expressed, and recovering the anti-CD3 scFv.

* * * * *